(12) United States Patent
Galeotti et al.

(10) Patent No.: US 9,932,374 B2
(45) Date of Patent: Apr. 3, 2018

(54) CLOSTRIDIUM DIFFICILE POLYPEPTIDES AS VACCINE

(71) Applicant: GlaxoSmithKline Biologicals SA, Rixensart (BE)

(72) Inventors: Cesira Galeotti, Poggibonsi (IT); Rosanna Leuzzi, Siena (IT); Mariagrazia Pizza, Siena (IT); Maria Scarselli, Siena (IT); Meera Unnikrishnan, Kenilworth (GB); Manuele Martinelli, Arezzo (IT)

(73) Assignee: GLAXOSMITHKLINE BIOLOGICALS SA, Rixensart (BE)

( * ) Notice: Subject to any disclaimer, the term of this patent is extended or adjusted under 35 U.S.C. 154(b) by 91 days.

(21) Appl. No.: 14/425,037

(22) PCT Filed: Sep. 19, 2013

(86) PCT No.: PCT/IB2013/058673
§ 371 (c)(1),
(2) Date: Feb. 28, 2015

(87) PCT Pub. No.: WO2014/045226
PCT Pub. Date: Mar. 27, 2014

(65) Prior Publication Data
US 2015/0315248 A1   Nov. 5, 2015

(30) Foreign Application Priority Data

Sep. 19, 2012 (GB) .................................. 1216748.2
Sep. 19, 2012 (GB) .................................. 1216749.0

(51) Int. Cl.
| | | |
|---|---|---|
| A61K 39/08 | (2006.01) | |
| C07K 14/33 | (2006.01) | |
| C07K 16/12 | (2006.01) | |
| A61K 39/00 | (2006.01) | |

(52) U.S. Cl.
CPC ............. *C07K 14/33* (2013.01); *A61K 39/08* (2013.01); *C07K 16/1282* (2013.01); *A61K 2039/55505* (2013.01); *A61K 2039/55566* (2013.01); *A61K 2039/70* (2013.01)

(58) Field of Classification Search
CPC ................................ A61K 39/00; A61K 39/08
USPC .......... 424/184.1, 185.1, 234.1, 239.1, 278.1
See application file for complete search history.

(56) References Cited

U.S. PATENT DOCUMENTS

2004/0029129 A1 * 2/2004 Wang .................. C07K 14/195
435/6.18
2011/0183360 A1 * 7/2011 Rajagopal .......... C07K 16/1282
435/7.32

FOREIGN PATENT DOCUMENTS

| WO | 98/59053 A1 | 12/1998 |
|---|---|---|
| WO | 01/94599 A1 | 12/2001 |
| WO | 02/077183 A2 | 10/2002 |
| WO | 2004/041857 A2 | 5/2004 |
| WO | 2008152429 A1 | 12/2008 |
| WO | 2011/060431 A2 | 5/2011 |
| WO | 2011068953 A2 | 6/2011 |
| WO | 2013/084071 A2 | 6/2013 |

OTHER PUBLICATIONS

Biazzo et al., "Diversity of cwp loci in clinical isolates of Clostridium difficile," Journal of Medical Microbiology, vol. 62, No. Pt 9, Sep. 1, 2013, pp. 1444-1452.
Chilton et al., "Comparative Proteomic Analysis of Clostridium difficile Isolates of Varying Virulence," Journal of Medical Microbiology, Jan. 20, 2014, vol. 63, pp. 489-503.
International Search Report for PCT/IB2013/058673, dated Mar. 7, 2014, pp. 1-6.
Kotloff et al., "Safety and immunogenicity of increasing doses of a clostridium difficile toxoid administrated to healthy adults," Infection and Immunity, vol. 69. No. 2, Feb. 1, 2001, pp. 988-995.
Mohammed et al., "The multidrug-resistant human pathogen Clostridium difficile has a highly mobile, mosaic genome," Nature Genetics, Jul. 1, 2006, vol. 38, No. 7, pp. 779-786.

* cited by examiner

*Primary Examiner* — Rodney P Swartz
(74) *Attorney, Agent, or Firm* — Birch, Stewart, Kolasch & Birch, LLP

(57) ABSTRACT

The invention provides methods, proteins, nucleic acids and antibodies for preventing or treating a *C. difficile* infection in a mammal.

19 Claims, 28 Drawing Sheets

Figure 3:
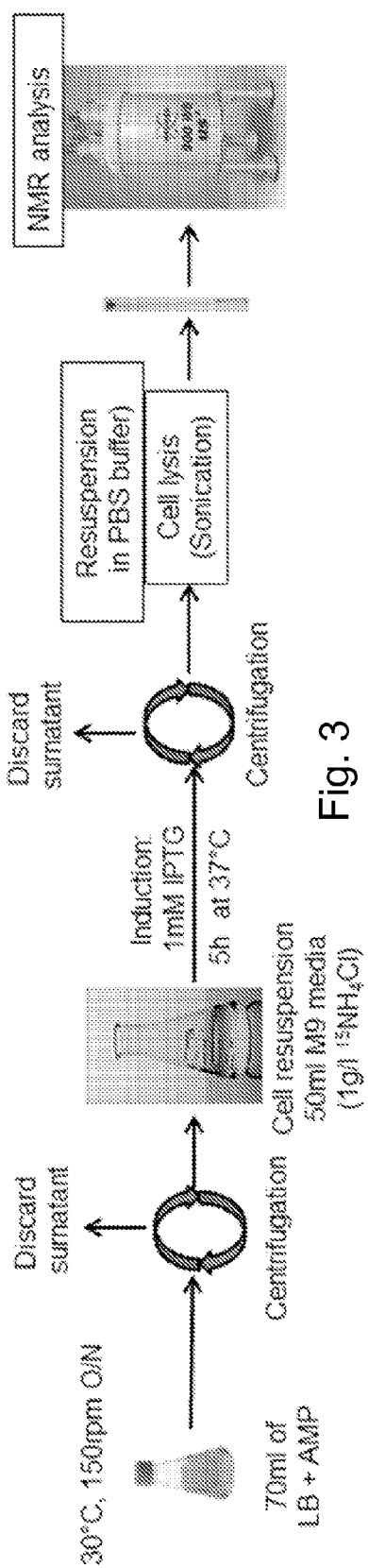

| Internal Name | GI | Locus Tag | Length (AA) | Strain | SEQ ID NOS: | Cloned SEQ ID NOS: | primers SEQ ID NOS: |
|---|---|---|---|---|---|---|---|
| DIF44 | 126698424 | CD0844 | 313 | 630 | 78 & 79 | 138 & 139 | 370 & 371 |
| DIF51 | 126698583 | CD0999 | 331 | 630 | 80 & 81 | 140 & 141<br>356 & 357 | 372 & 373 |
| DIF130 | 126700259 | CD2645 | 424 | 630 | 92 & 93 | 152 & 153<br>358 & 359 | 380 & 381 |
| DIF153 | 126700446 | CD2830 | 220 | 630 | 299 & 300 | 321 & 322 | 346 & 347 |
| DIF183 | 126701297 | CD3669 | 191 | 630 | 186 & 187 | 188 & 189<br>360 & 361 | 424 & 425 |
| DIF192 | 126698619 | CD1035 | 679 | 630 | 104 & 105 | 164 & 165 | 384 & 385 |
| DIF208 | 126700447 | CD2831 | 972 | 630 | 132 & 133 | 432 & 433 | 422 & 423 |
| DIF208A | 126700447 | CD2831 | 448 | 630 | 110 & 111 | 170 & 171 | 414 & 415 |
| DIF208B | 126700447 | CD2831 | 457 | 630 | 112 & 113 | 172 & 173 | 416 & 417 |
| DIF232 | 126698615 | CD1031 | 693 | 630 | 124 & 125 | 184 & 185 | 400 & 401 |

Fig. 1

| Name | Protein | PSORTb | Secretome 630 | Secretome 20291 | NMR | Confocal microscopy |
|---|---|---|---|---|---|---|
| Dif44 | cell surface protein cwp25 | Cell wall | | yes | folded | surface |
| Dif51 | ABC transporter substratebinding protein lipoprotein | Unknown | | | folded | surface |
| Dif130 | extracellular solute-binding protein | Unknown/ Multiple Localizatio n | | | | |
| Dif153 | Hypothetical protein CD2830 | unknown | yes | yes | | surface |
| Dif183 | hypothetical protein CD3669 | unknown | yes | yes | folded | surface |
| Dif192 | Nacetylmuramoyl -L-alanine amidase cwp16 | Cell wall | yes | yes | folded | surface |
| Dif208 Dif208 A, Dif208 B | collagen-binding protein sortase substrate | Cell wall | | yes | Partially folded | surface |
| Dif232 | Unknown | Unknown | | | | surface |

Fig. 2

Dif 232– 4°C
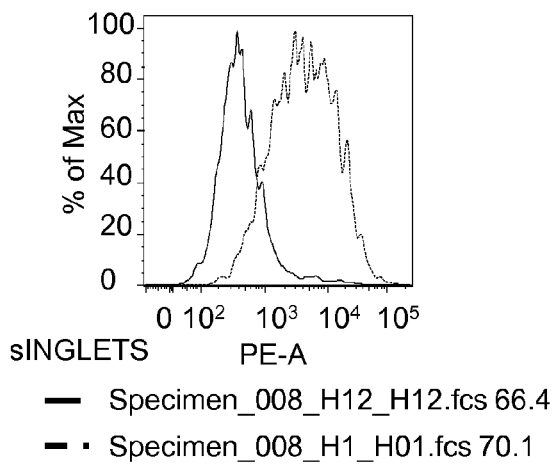
sINGLETS   PE-A
— Specimen_008_H12_H12.fcs 66.4
‒ · Specimen_008_H1_H01.fcs 70.1
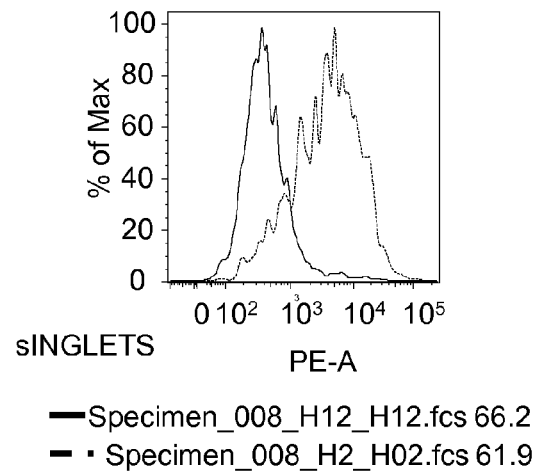
sINGLETS   PE-A
—Specimen_008_H12_H12.fcs 66.2
‒ · Specimen_008_H2_H02.fcs 61.9
Dif 232– 37°C
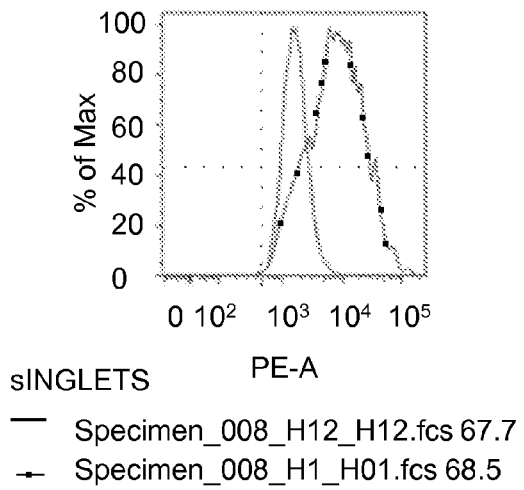
sINGLETS   PE-A
— Specimen_008_H12_H12.fcs 67.7
‒ Specimen_008_H1_H01.fcs 68.5
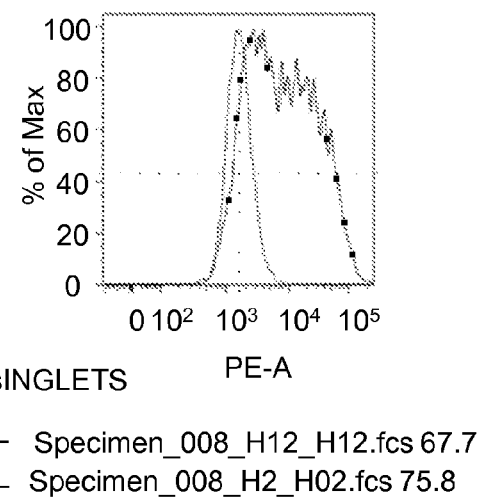
sINGLETS   PE-A
— Specimen_008_H12_H12.fcs 67.7
‒ Specimen_008_H2_H02.fcs 75.8
Fig. 6

| Name | Annotation | Locus Tag | Strain | MW | Binding to the cells | | |
|---|---|---|---|---|---|---|---|
| | | | | | FACS on Vero cells | Microscopy on Caco-2 cells | Microscopy on Vero cells |
| Dif44 | cell surface protein cwp25 | CD0844 | 630 | | - | | |
| Dif208A | putative collagen-binding protein | CD2831 | 630 | 51 | + | +/- | +/- |
| Dif232 | putative cell wall anchored protein, cellulose synthase activity | CD1031 | 630 | 73 | + (37°C-4°C) | - | ND |
| Dif208B | putative collagen-binding protein | CD2831 | 630 | 52 | + | + | |
| Dif51 | ABC transporter substrate binding lipoprotein | CD0999 | 630 | 86 | + (37°C-4°C) | + | ND |
| Dif192 | cell surface protein (putative N-acetylmuramoyl-L-alanine amidase cwp16 | CD1035 | 630 | 83 | + (37°C-4°C) | ++ | NO |

Fig. 7

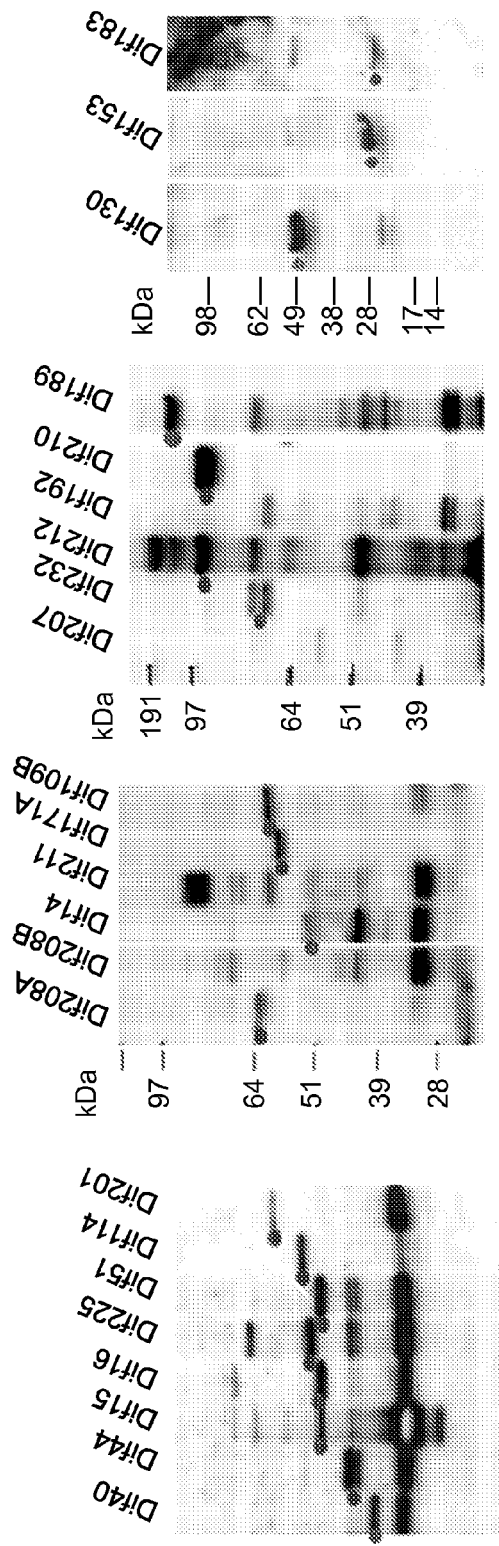
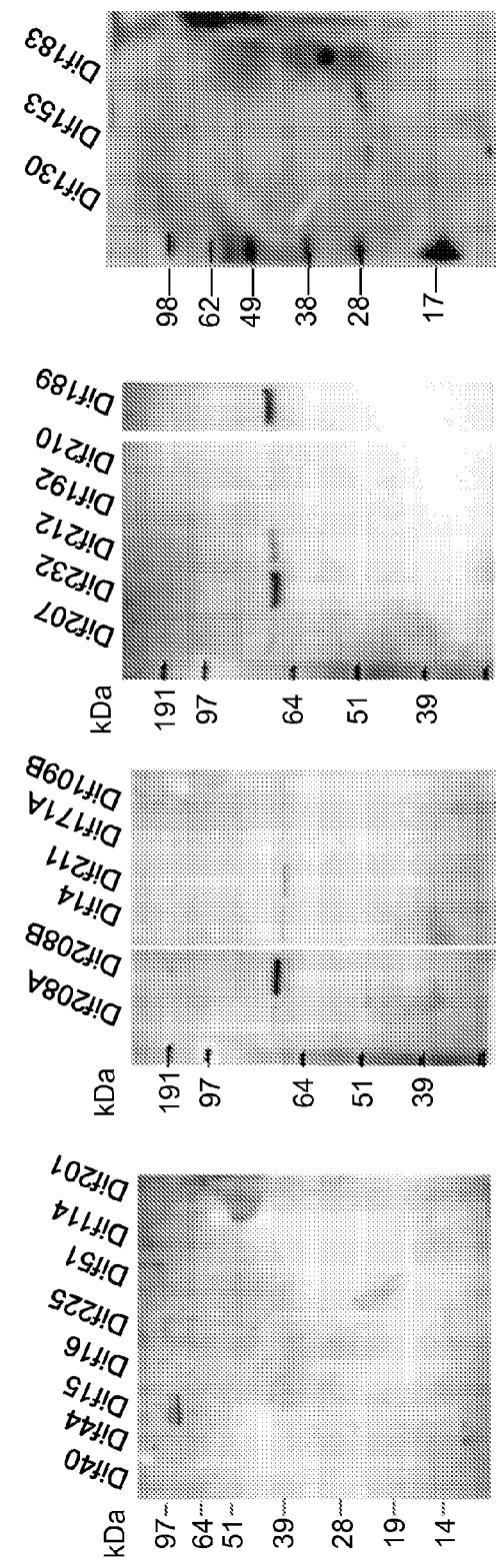
Fig. 10 A
Fig. 10 B

| Method | | PROTEIN CHIP | | | | | | | | WESTERN BLOT |
|---|---|---|---|---|---|---|---|---|---|---|
| name of serum | No serum | DonorA 1:500 | DonorB 1:500 | DonorC 1:500 | DonorD 1:500 | DonorE 1:500 | 10WH 1:500 | 3453WH 1:500 | 4016BL 1:500 | 4697WH 1:500 | 4705WH 1:200 | 4705WH 1:500 |
| Proteins | MFI | MFI | MFI | MFI | MFI | MFI | MFI | MFI | MFI | MFI | MFI | |
| Df51 His | 209 | 697 | \ | 1384 | 640 | \ | \ | 790 | 469 | 363 | 951 | NO |
| Df104 His | 148 | 624 | \ | 1631 | 626 | \ | \ | 962 | 314 | 326 | 1185 | YES |
| Df130 His | 101 | 1048 | \ | 3466 | 1307 | \ | \ | 1897 | 839 | 377 | 2352 | YES |
| Df1698 His | 72 | 199 | \ | 324 | 179 | \ | \ | 270 | 90 | 124 | 180 | NO |
| Df194 His | 134 | 264 | \ | 505 | 303 | \ | \ | 437 | 176 | 193 | 1159 | YES |
| Df210 His | 41 | 129 | \ | 232 | 104 | \ | \ | 135 | 61 | 29 | 153 | NO |
| Df211 His | 564 | 1098 | \ | 2317 | 1133 | \ | \ | 1064 | 612 | 704 | 1087 | NO |
| Df231 His | 52 | 487 | \ | 1215 | 617 | \ | \ | 625 | 447 | 133 | 1806 | YES |
| Df232 His | 235 | 475 | \ | 760 | 431 | \ | \ | 475 | 240 | 265 | 721 | YES |
| Controls: | | | | | | | | | | | | |
| MI-His | 88 | 136 | \ | 208 | 134 | \ | \ | 115 | 76 | 110 | 130 | |
| PBS Gly | 22 | 25 | \ | 32 | 22 | \ | \ | 26 | 26 | 24 | 26 | |

MFI: mean fluorescence intensity

▓ MFI > 1000 and at least 5-fold higher than the negative control

Fig. 13A

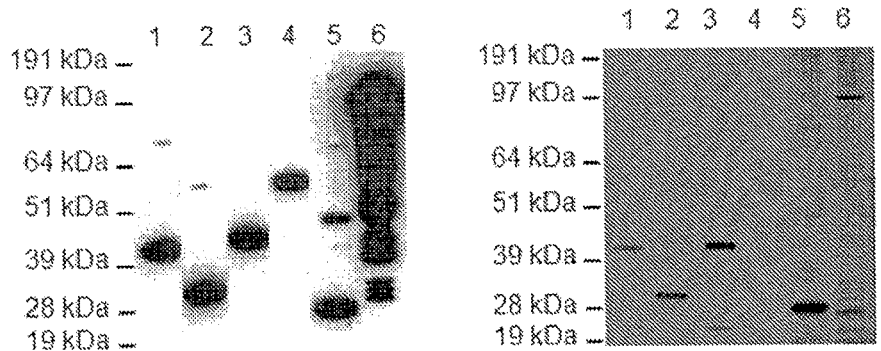

Fig. 14

```
LF      -DTKIQEAQLNINQEWNKALGLPKYTKLITFNVHNRYASNIVESAYLILNEWKNNIQSDL
DIF153  DSTTIQQNKDTLSQIVVFPTGN--YDKNEANAMVNRLAN--IDGKYLNALK-QNNLK---
         .*.**:  :  .:.*     .  *  *  *  :  :  ** *.  ::.  **    :  :**::

LF      IKKVTNYLVDGNGRFVFTDITLPNIAEQYTHQDEIYEQVHSKGLYVPESRSILLHGPSKG
DIF153  IKLLSGKLTDEK-EYAYLKGVVP---KGWEGTGKTWDDVPGLGGSTVALR-IGFSNKGKG
        ** ::. *.*    : .:.:   ..:*   :  :    .: :::*  . *   *   * *  :  .**

LF      VELRNDSEGFIHEFGHAVDDYAGYLLDKNQSDLVTNSKKFIDIFKEEGSNLT--SYGRTN
DIF153  HDAIN---LELHETAHAIDHIV--------LNDISKSAQFKQIFAKEGRSLGNVNYLGVY
         :  *       :** .**:*. .       :  :::*  :*  :** :**  .*   .*    .

LF      EAEFFAEAFRLMHSTDHAERLKVQKNAPKTFQFINDQIKFIINS  SEQ ID NO: 474
DIF153  PEEFFAESFAYYYLNQDTN-SKLKSACPQTYSFLQNLAK-----  SEQ ID NO: 322
        *****:*    :   .:.::  *::.  .*:*:.*:::   *
```

CLOSTRIDIUM DIFFICILE POLYPEPTIDES AS VACCINE

RELATED APPLICATIONS

This application is the U.S. National Phase of International Patent Application No. PCT/IB2013/058673, filed Sep. 19, 2013 and published in English, which claims the benefit of Great Britain Patent Application No. 1216748.2, filed Sep. 19, 2012 and Great Britain Patent Application No. 1216749.0, filed Sep. 19, 2012. The complete contents of each of the foregoing applications are hereby incorporated herein by reference for all purposes.

REFERENCE TO SEQUENCE LISTING SUBMITTED VIA EFS-WEB

This application includes an electronically submitted sequence listing in .txt format. The .txt file contains a sequence listing entitled "2017_05_08_2801_0268PUS1_ST25.txt" created on May 8, 2017 and is 1,037,169 bytes in size. The sequence listing contained in this .txt file is part of the specification and is hereby incorporated by reference herein in its entirety.

TECHNICAL FIELD

This invention relates to polypeptides derived from *Clostridium difficile* (*C. difficile*), particularly methods for treating and preventing *C. difficile* infection using same.

BACKGROUND ART

*Clostridium difficile* is a Gram-positive, rod shaped, anaerobic spore-forming bacterium. The first fully sequenced *C. difficile* genome was published in 2006 [1] and 3776 predicted coding sequences were identified. *C. difficile* is a normal component of the gut flora, estimated to be present in 3% of the general population without signs of disease. In situations where the natural balance of the gut flora is disturbed, then *C. difficile* can become more prevalent. This overgrowth causes the bacterium to start producing toxins under the control of a quorum signalling regulator. The most frequent cause of a disruption to the natural balance of the gut flora is the administration of antibiotics which are deleterious to some gut bacteria, but which do not affect *C. difficile*. *C. difficile* is the primary cause of antibiotic associated diarrhoea (AAD), though symptoms may extend to life-threatening pseudomembraneous colitis. The highest prevalence of infection is in elderly hospitalised patients, though infections are on the increase in non-typical groups, such as adolescents and pregnant females [2]. It is has been observed that between 12% and 35% of those infected with *C. difficile* relapse within 2 months [3].

*C. difficile* was only identified as the causative agent of AAD in the 1970s. Since then a number of strategies for combating the infection have been attempted. Specific antibiotics, such as vancomycin, metronidazole, nitazoxanamide, bacitracin or fusidic acid were used initially to treatment for *C. difficile* infection, and continue to be employed today (see references 4, 5 and 6). Widespread treatment with these antibiotics is not favoured, though, due to the risk of *C. difficile* and also other gut bacteria becoming resistant over time. Recently, treatment with vaccines based upon the toxoids secreted by the bacterium and passive immunotherapy targeting such toxins have been adapted (references 7 and 8). A toxoid vaccine with and without adjuvant is in phase II trials in patients 18-85 years old to determine efficacy in preventing recurrent CDI in the nine week period after the third dose of this vaccine. Toxoid vaccines typically require repeat administrations and an adjuvant in order to elicit an immune response. Further, their administration is frequently associated with injection site immune reactions. However, toxin-based vaccines only prevent toxin binding, neutralising inflammatory effects; such vaccines are generally unable to prevent colonization completely or clear an existing pathogen from the body. For example, spores may remain meaning that further infection or recurrence of infection with associated symptoms is likely.

Thus there is a need for improved compositions and methods of treating or preventing *C. difficile* infection. In particular, there is need for polypeptides that will be useful as vaccine components and that may be used to limit or eliminate the colonization—including spores—in vaccinated subjects, further preventing *C. difficile* transmission. It is an object of the invention to provide polypeptides and compositions which are effective in raising immune responses against *C. difficile* for use in the development of vaccines for preventing and/or treating *C. difficile* associated diseases.

FIG. 1: Provides summary information on each of the selected polypeptides including Internal Name, Gene Identifier (GI), Locus Tag, Amino Acid Sequence Length (AA), identity of Strain from which the polypeptide was originally isolated, the SEQ ID NOs corresponding to each polypeptide, the SEQ ID NOs of the cloned polypeptides and various primers.

FIG. 2: Summarises the results of Secretome, NMR and Confocal microscopy experiments.

FIG. 3: Provides a schematic of the process used in NMR analysis

Figure 4:
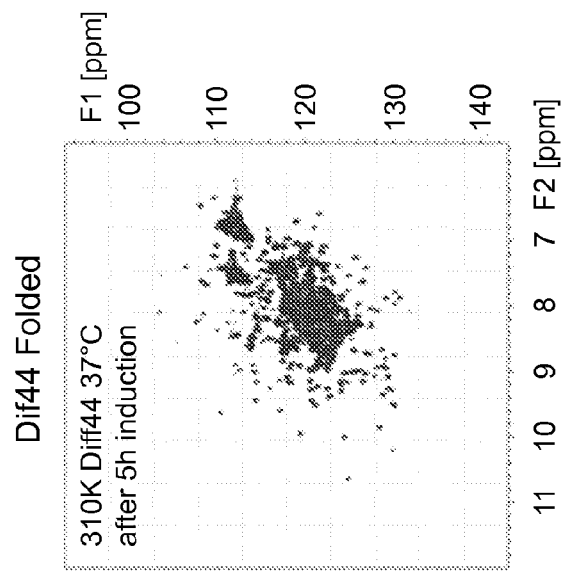

FIG. 4: 15N-HSCQ spectra for Diff44

Figure 5:
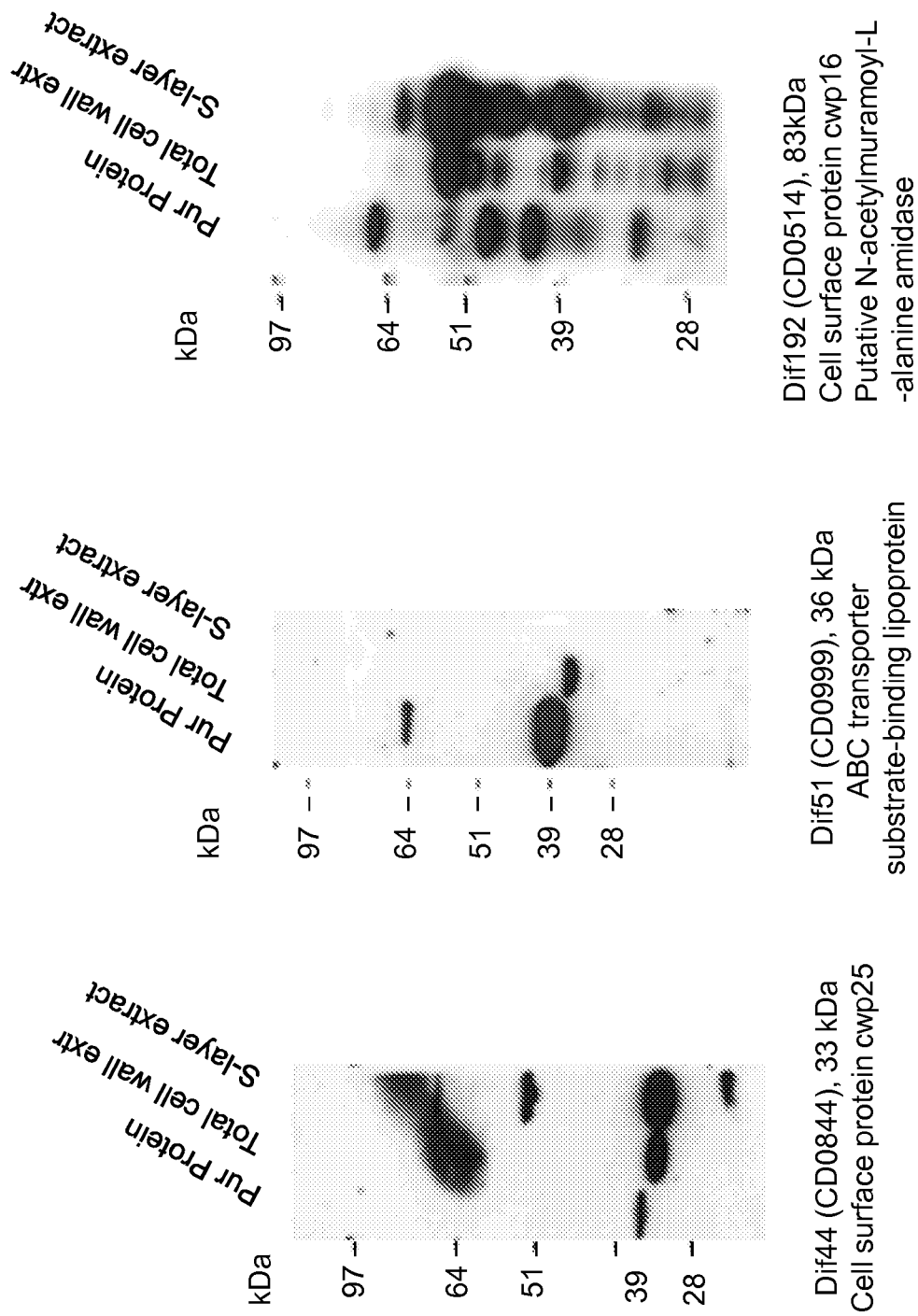

FIG. 5: Demonstrates the results of Surface-exposure studies by Western Blot

FIG. 6: Provides representative FACS data for Dif232

FIG. 7: Provides a summary of data relating to cell binding experiments. Binding assays of recombinant polypeptides on human Vero cells by FACS analysis and on human Vero and Caco-2 cells by confocal microscopy FIG. 8: Western blot analysis of total cell extracts of *C. difficile* reference strains (630, R20291 and M120) and clinical isolates representing different PCR-ribotypes using anti-Dif192 and Anti-Dif44 antibodies. The Dif192 mature form is 647aa and 71.1 kDa. The Dif44 mature form is 286aa and 31 kDa.

Figure 9:
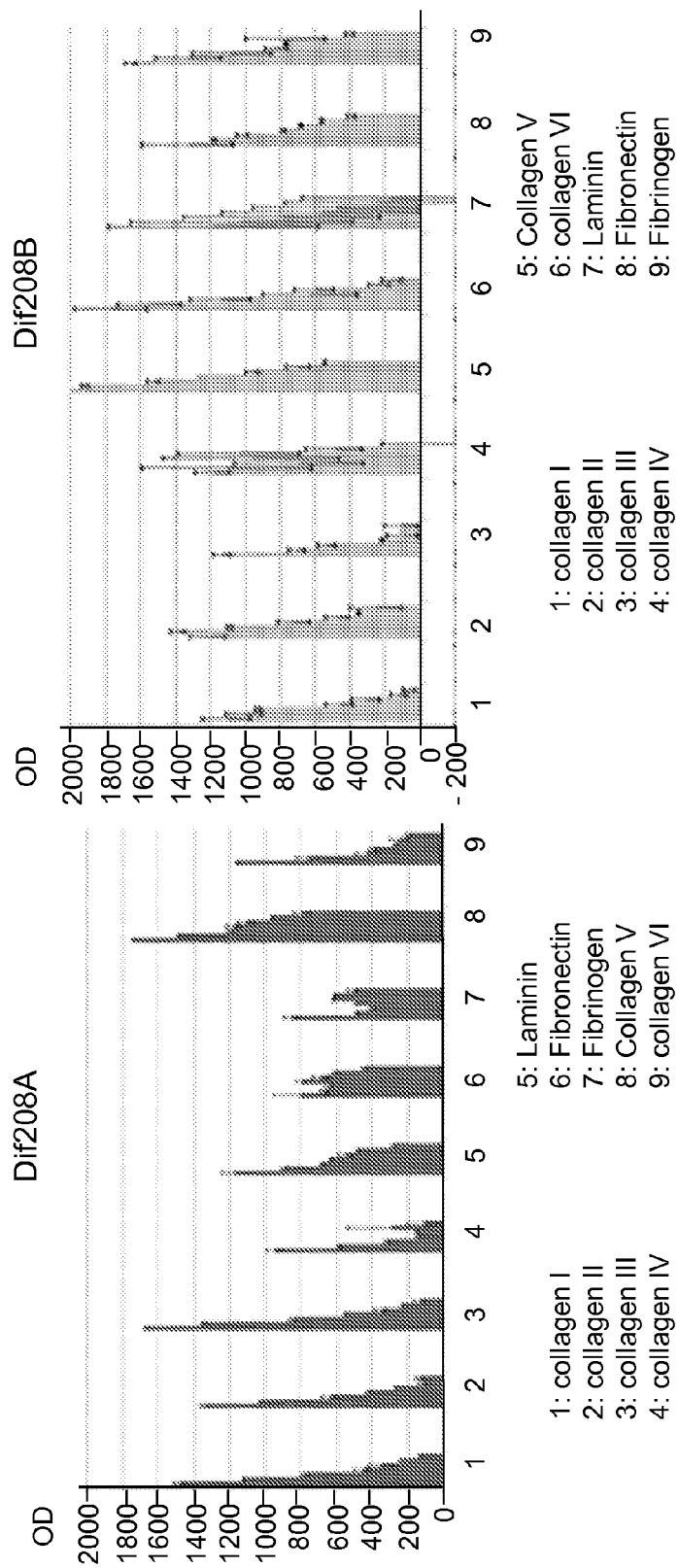

FIG. 9: Provides a summary of results relating to ELISA binding assays.

FIG. 10: Recognition of *C. difficile* recombinant polypeptides (100 ng) (A) by sera from hamsters by Western blot by sera from hamsters vaccinated with toxin A and B combination and challenge with *C. difficile* 630 strain or B1 strain, (B) by serum from hamster not infected.

Figure 11:
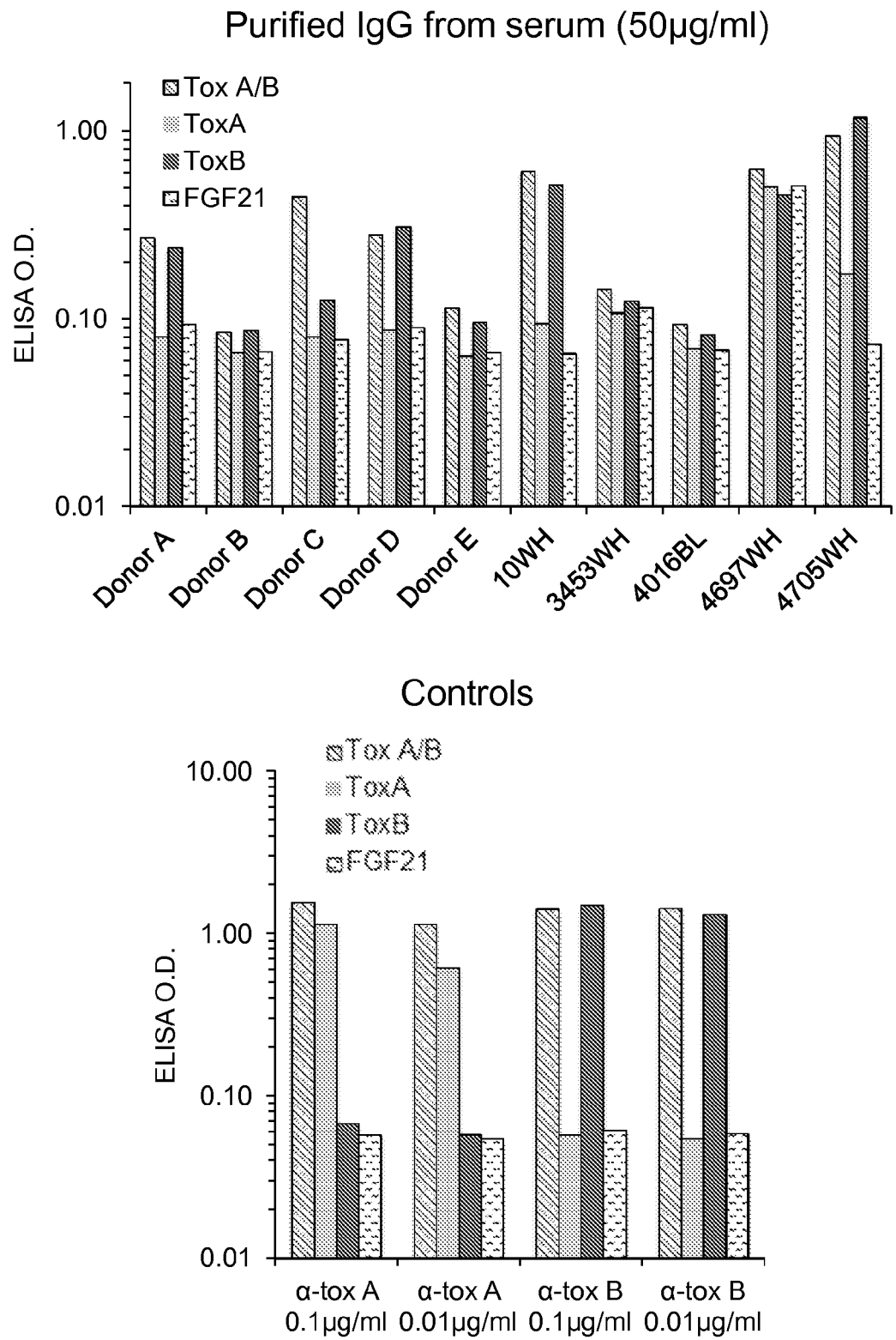

FIG. 11: Recognition of *C. difficile* recombinant polypeptides by human serum antibodies.

FIG. 12: Recognition of *C. difficile* recombinant polypeptides by human serum antibodies.

FIG. 13: Recognition of *C. difficile* recombinant polypeptides by human serum antibodies.

FIG. 14: Recognition of *C. difficile* recombinant polypeptides by mouse serum antibodies. Immunoblotting on recombinant proteins using serum of mice immunized with concentrated supernatants (5) Dif183 (CD3669).

FIG. 15: Alignment between Dif153 (SEQ ID NO: 322) and the C-terminus of the Anthrax Lethal Factor (SEQ ID NO: 474) (residues 589-810); Dif153 is homologous to the C-terminus of the Anthrax Lethal Factor; N-terminal domain, necessary for interaction with PA, is missing; the catalytic site (HEXXH) is conserved.

Figure 16:
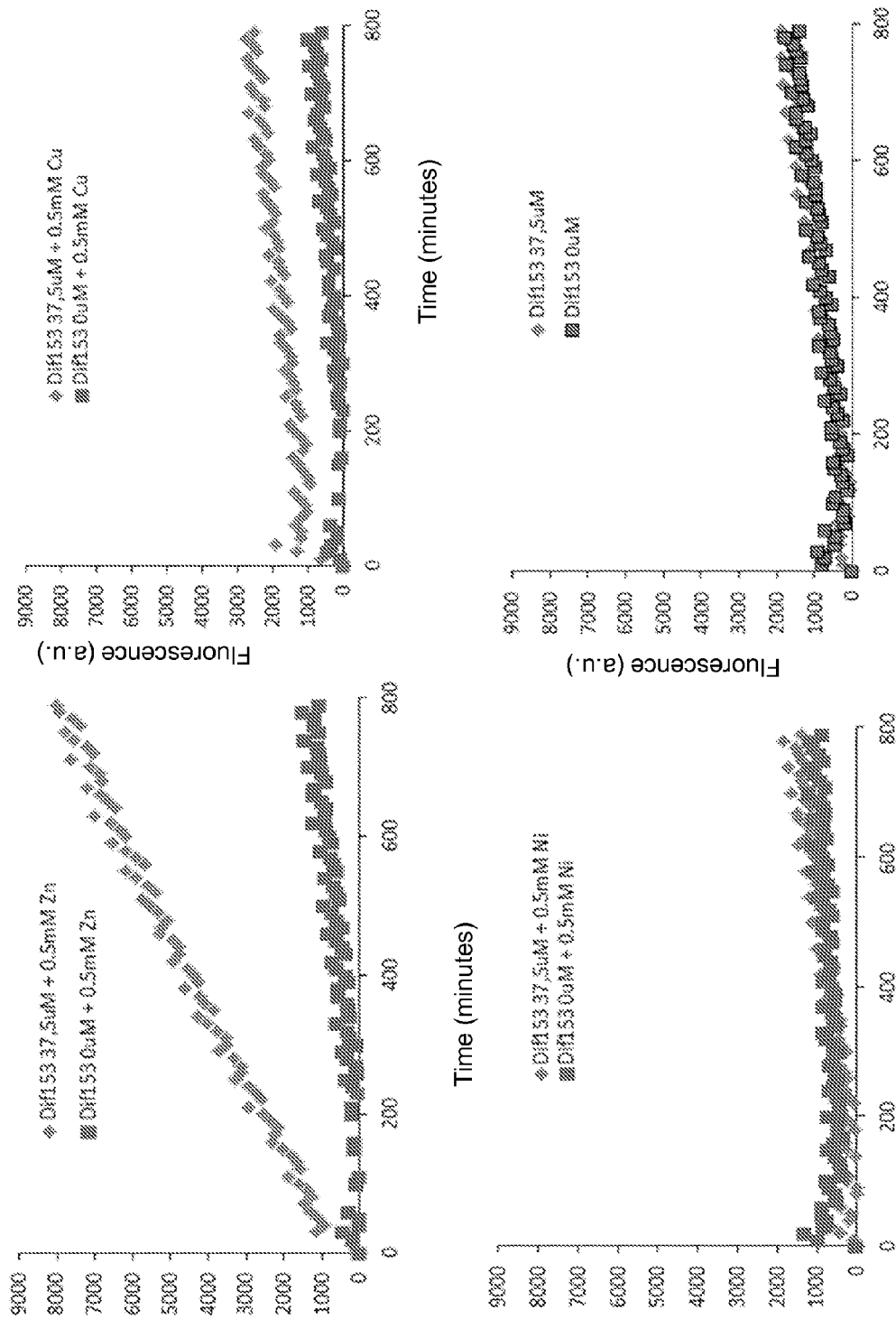

FIG. 16: Fluorimetric assay showing a weak gelatinase/collagenase activity for Dif153 in the presence of Zinc.

Figure 17:
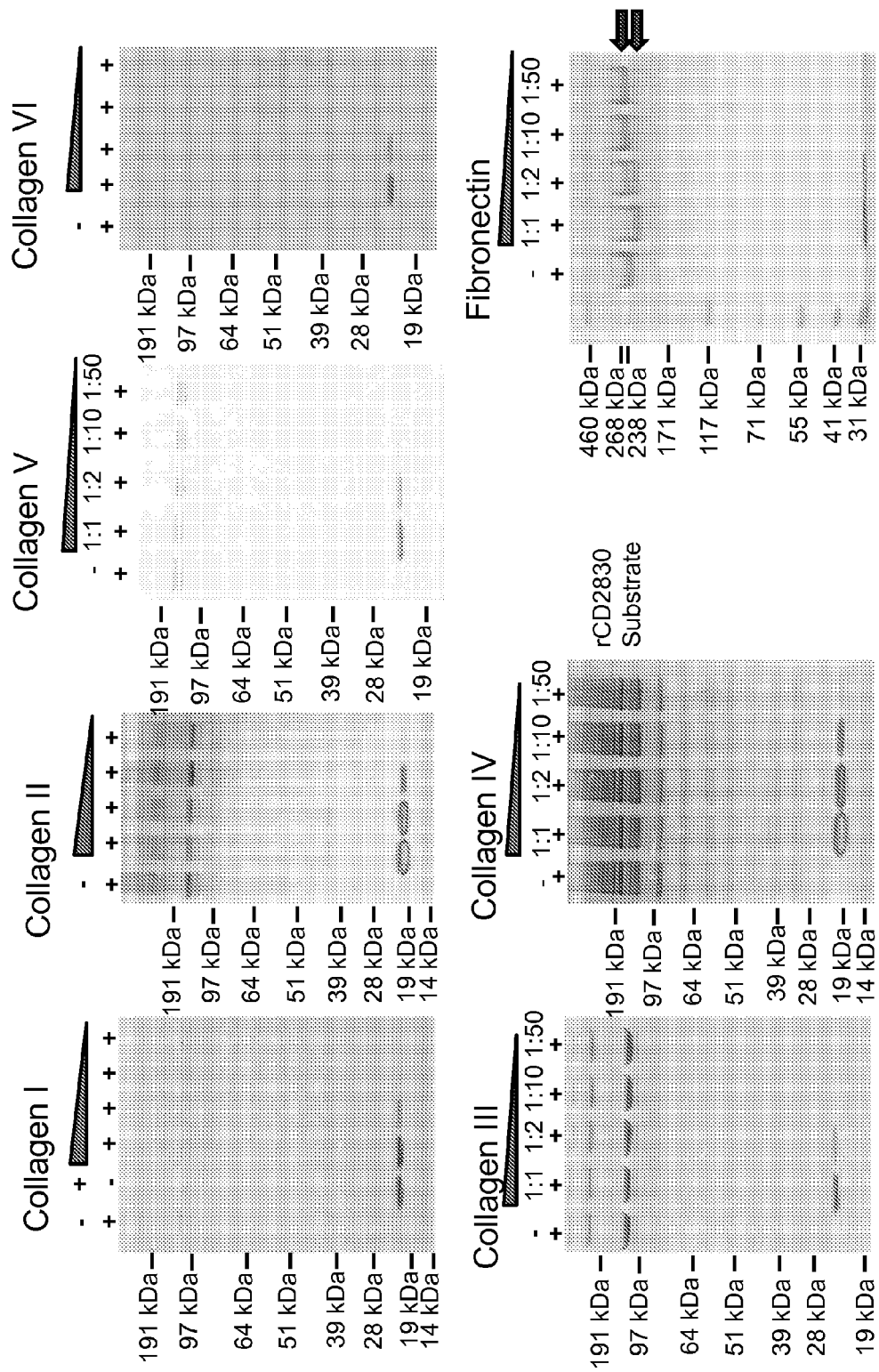

FIG. 17: Decreasing amounts of recombinant Dif153 were incubated with the same amount of the desired substrate (collagen I-VI, fibronectin). The reaction was carried out at 37° C. for 16 h in the presence of 0.5 mM ZnCl2. Reaction products were loaded on gels for SDS-PAGE and then stained with Silver or Coomassie.

Figure 18:
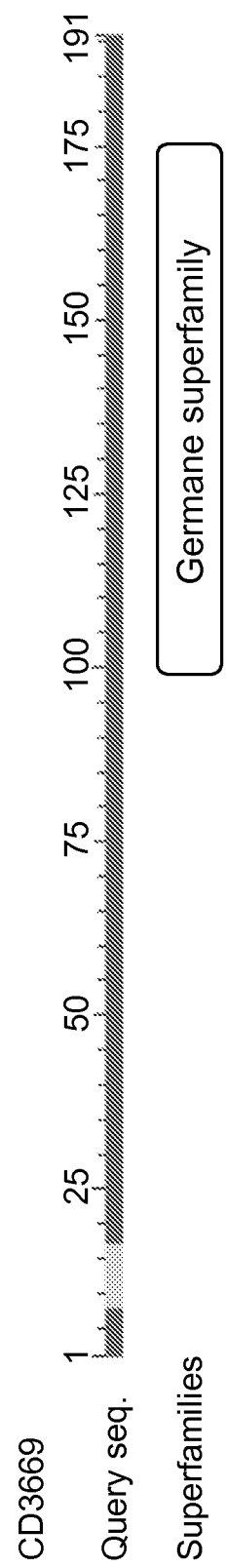

FIG. 18: Dif183 contains a GerMN domain.

Figure 19A:
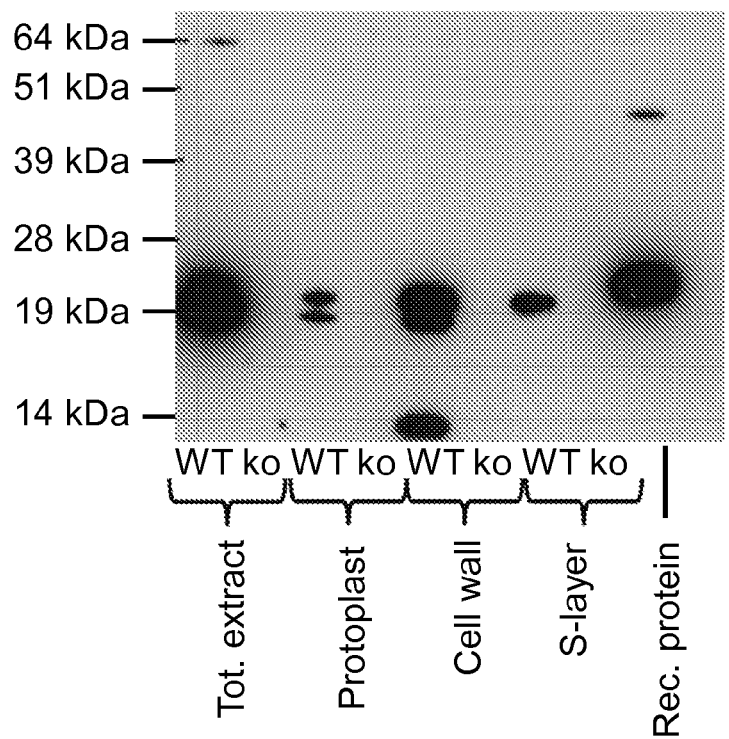
Figure 19B:
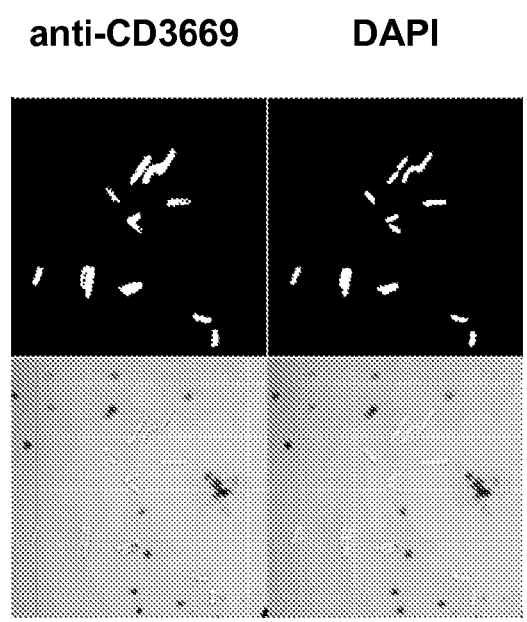

FIG. 19: (A) Western blot analysis on strain 630 cell fractions using an anti-Dif183 serum; (B) Immunofluorescence analysis on strain 630 vegetative cells.

Figure 20:
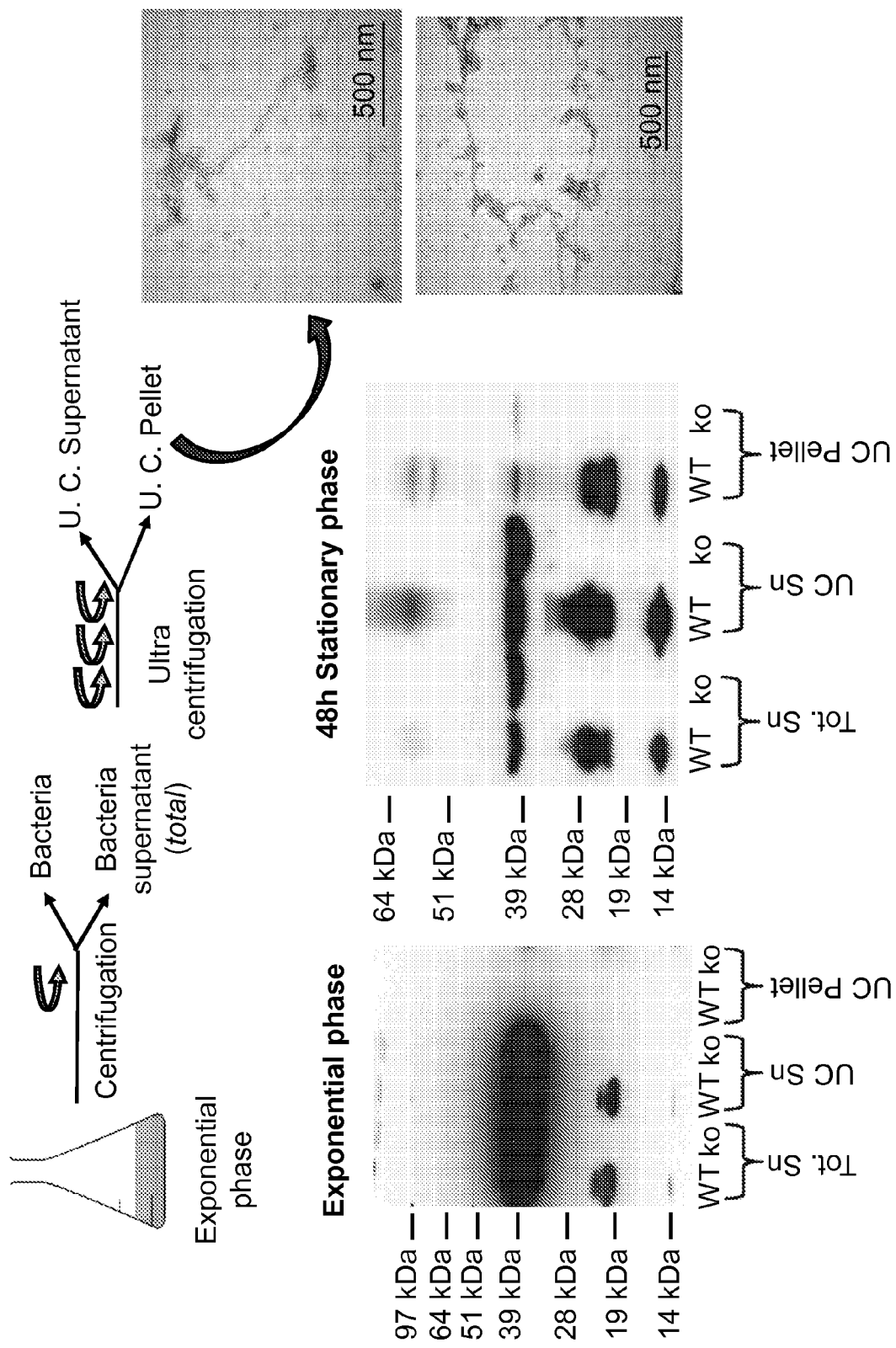

FIG. 20: Analysis of Dif183 presence in culture supernatant fractions by Western blotting.

Figure 21:
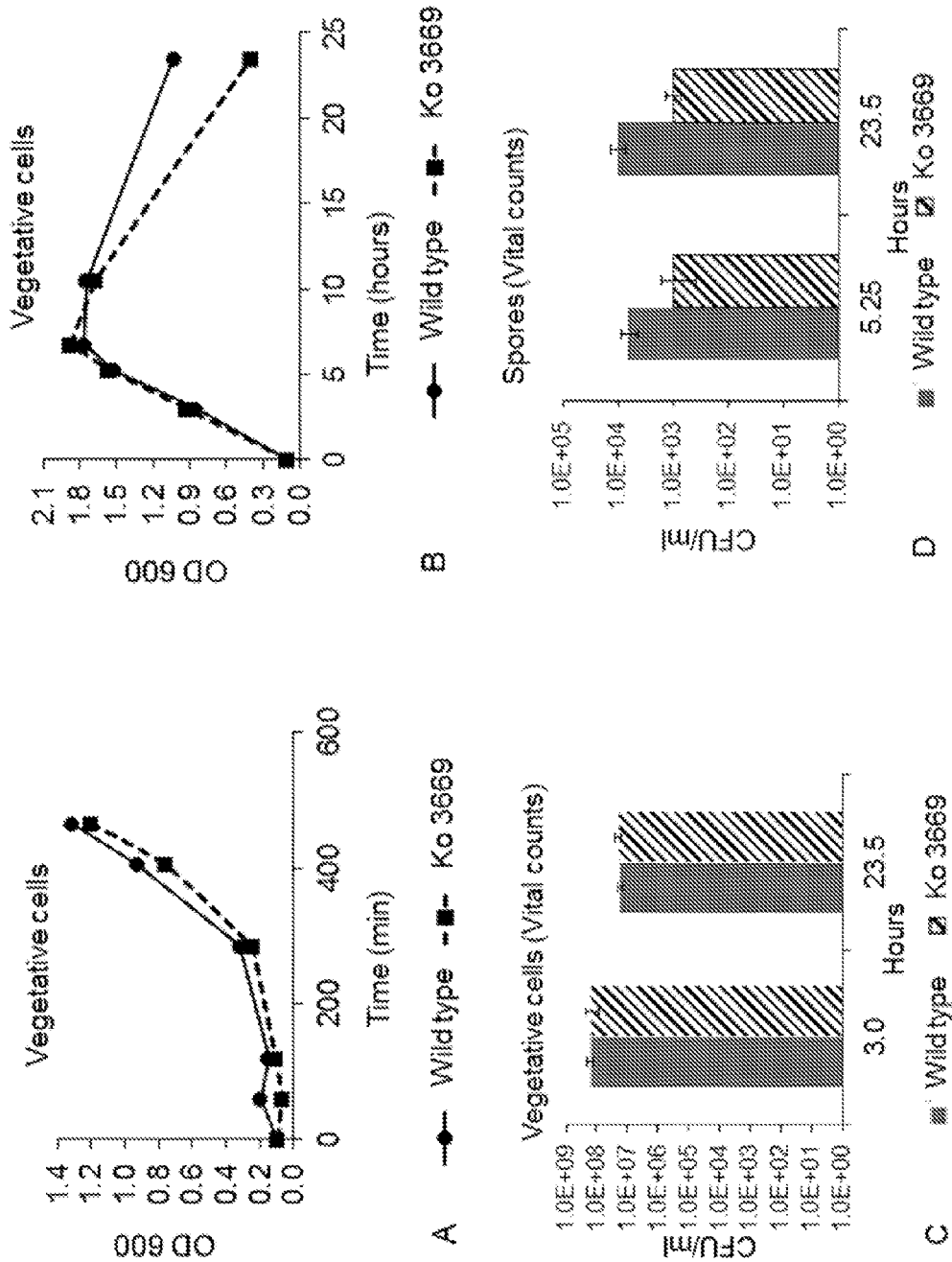

FIG. 21: Dif183 deletion mutant has a sporulation/germination phenotype.

Figure 22:
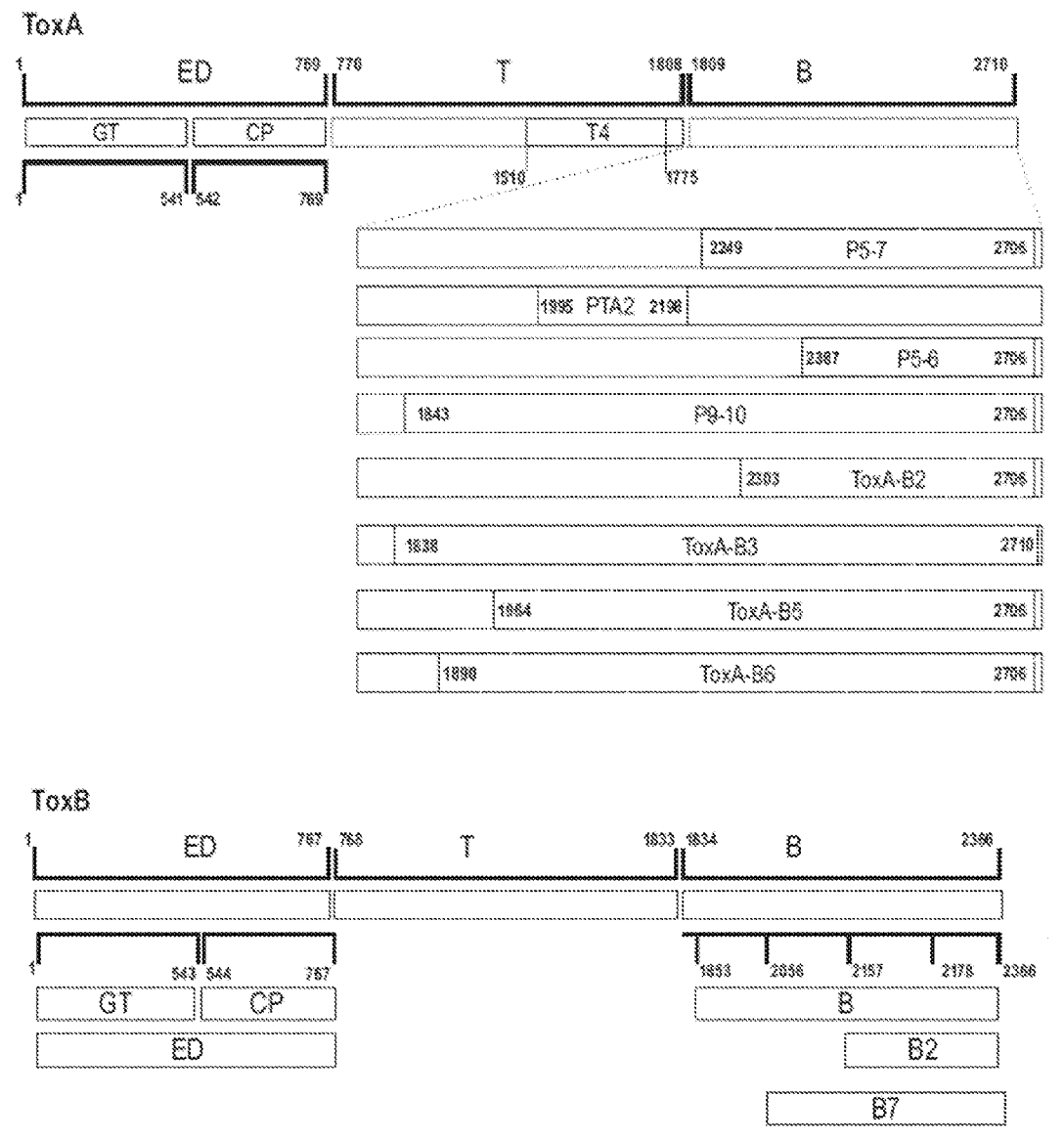

FIG. 22: Schematic representation of preferred *C. difficile* recombinant toxin fragments. ED=enzymatic domain; GT=glucosyl-transferase domain; CP=cysteine protease domain; T—translocation domain; B=binding domain. All domains are soluble with the exception of the T4 and PTA2 domains of TcdA, which are insoluble.

Figure 23:
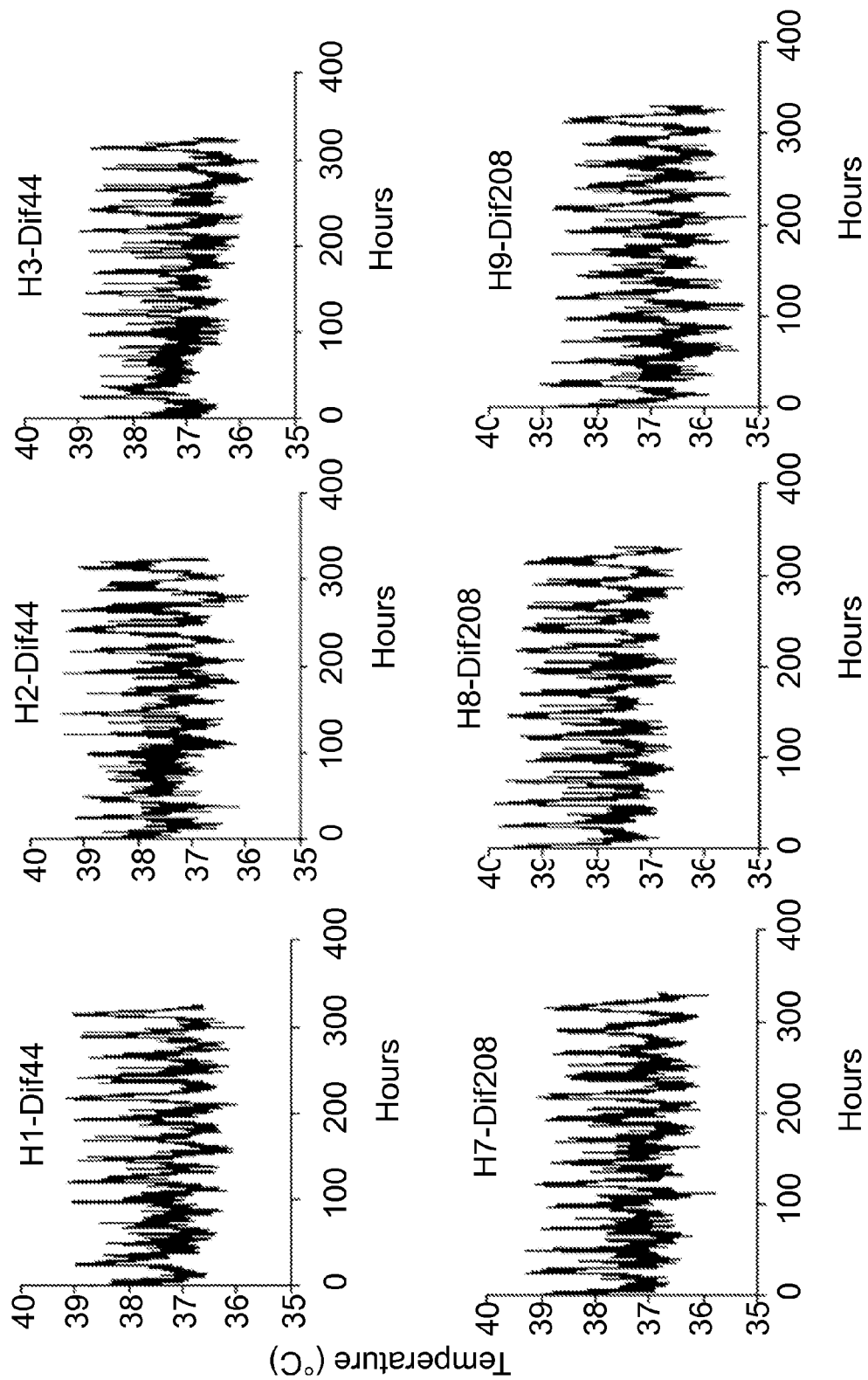

FIG. 23: Shows temperature fluctuations of vaccinated animals following administration of the toxin fragment antigens with Dif44 or Dif208, and subsequent *C. difficile* 630 challenge.

Figure 24:
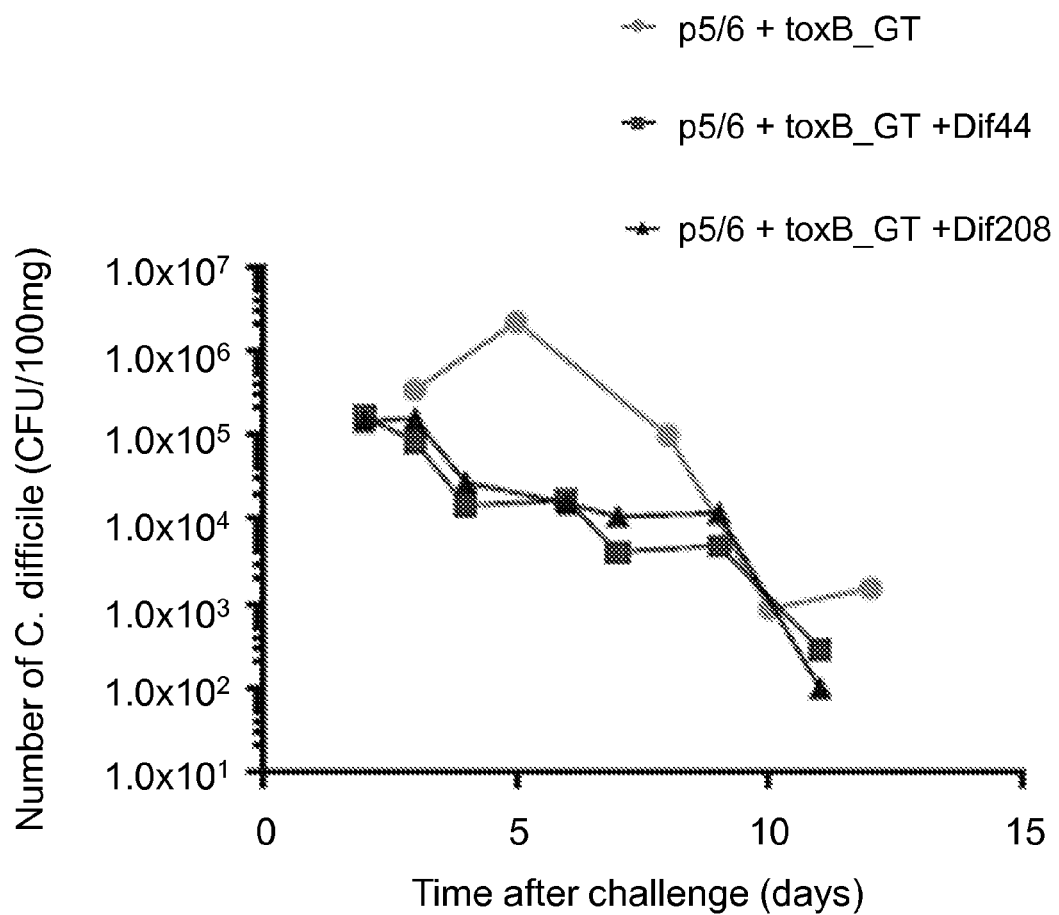

FIG. 24: Shows the number of *C. difficile* (CPU/100 mg) observed in faecal pellets collected after *C. difficile* challenge in animals vaccinated with toxin fragment antigens in combination with Dif44 or Dif208.

Figure 25:
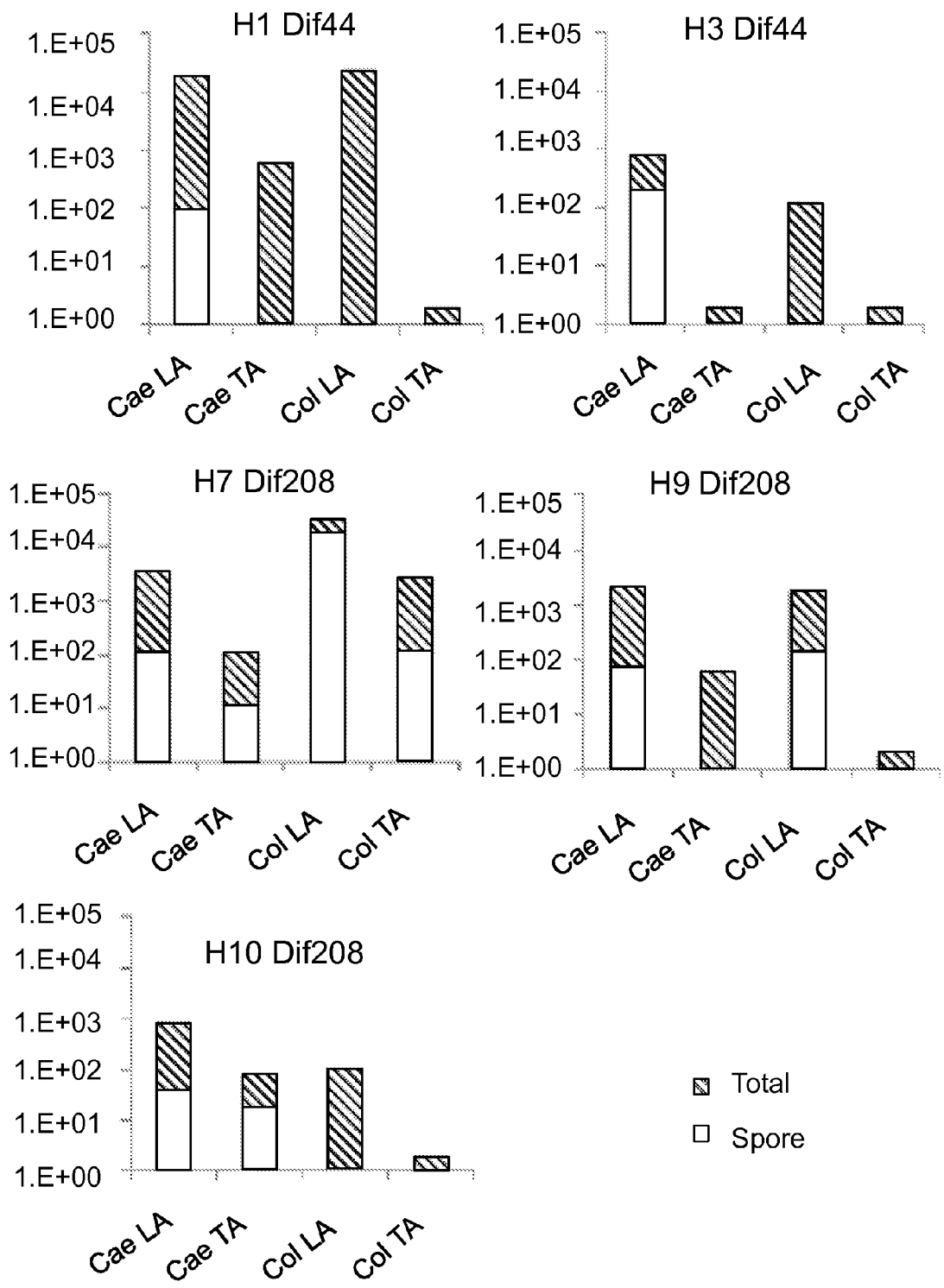

FIG. 25: Shows the numbers of *C. difficile* in the lumen of the caecum (Cae-LA), the lumen of the colon (Col-LA), the tissue of the caecum (Cae-TA) and the tissue of the colon (Col-TA), at the experimental end point for animals vaccinated with toxin fragment antigens in combination with Dif44 or Dif208 and subjected to subsequent *C. difficile* 630 challenge.

Figure 26:
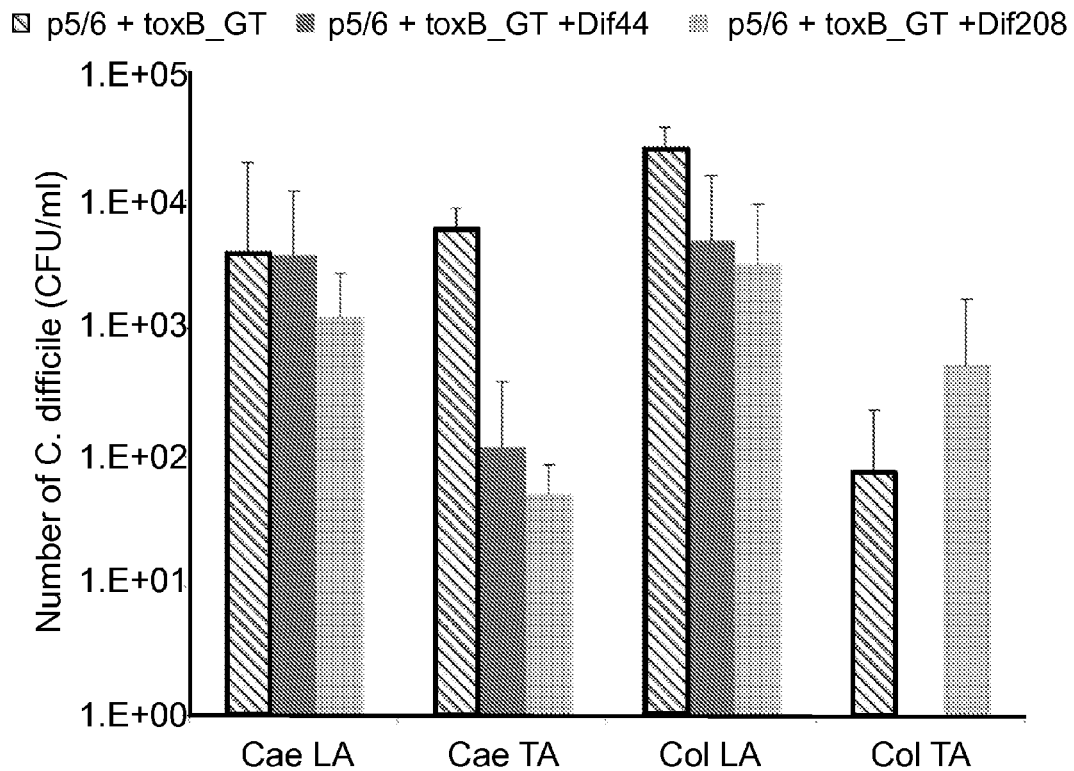

FIG. 26: Shows the total number of *C. difficile* isolated at the experimental end point (day 14 after challenge) of all vaccinated groups.

Figure 27:
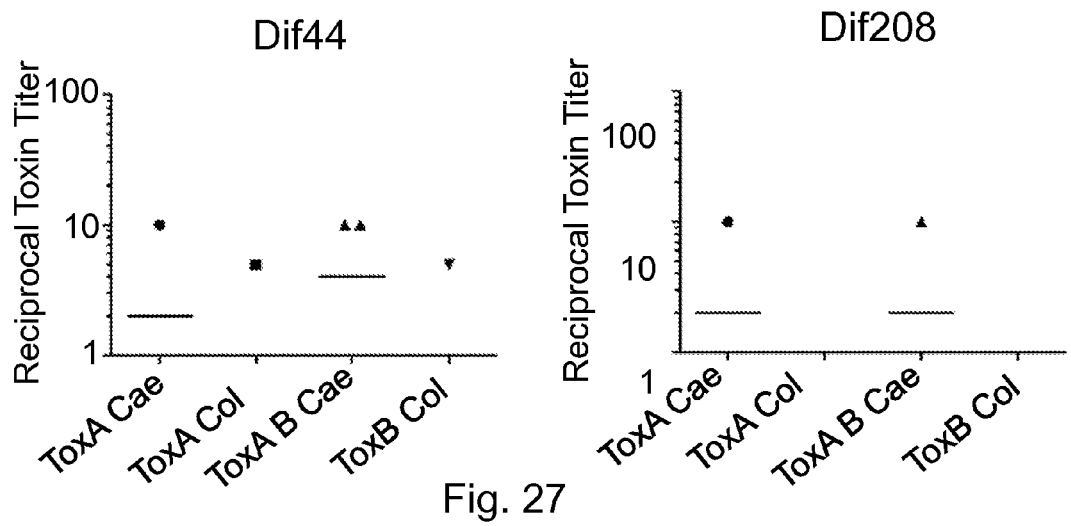

FIG. 27: Shows the toxin titre in gut samples at the experimental endpoint.

Figure 28:
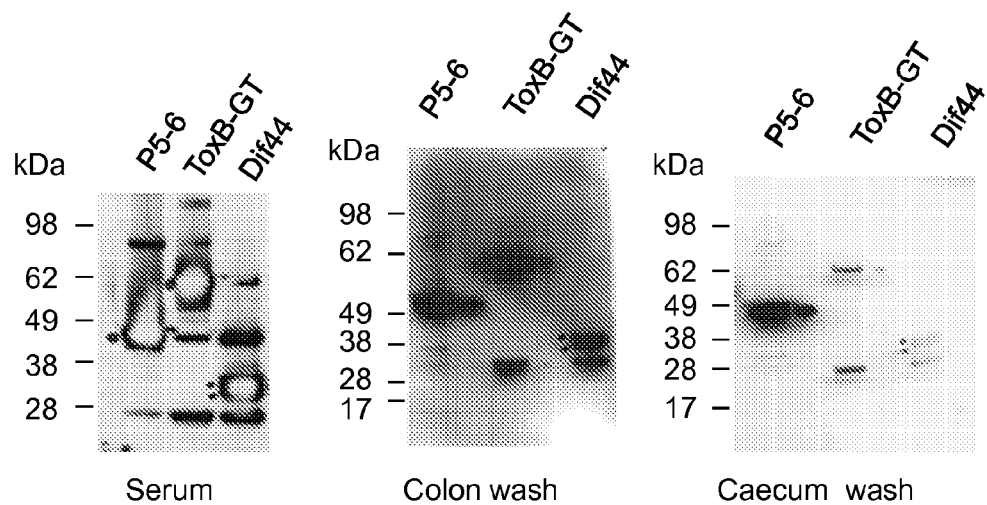

FIG. 28: Shows the recognition of recombinant ToxAp5_6, ToxB_GT and Dif44 by serum or colon and caecum washes from hamsters 1-5 of Example 15.

Figure 29:
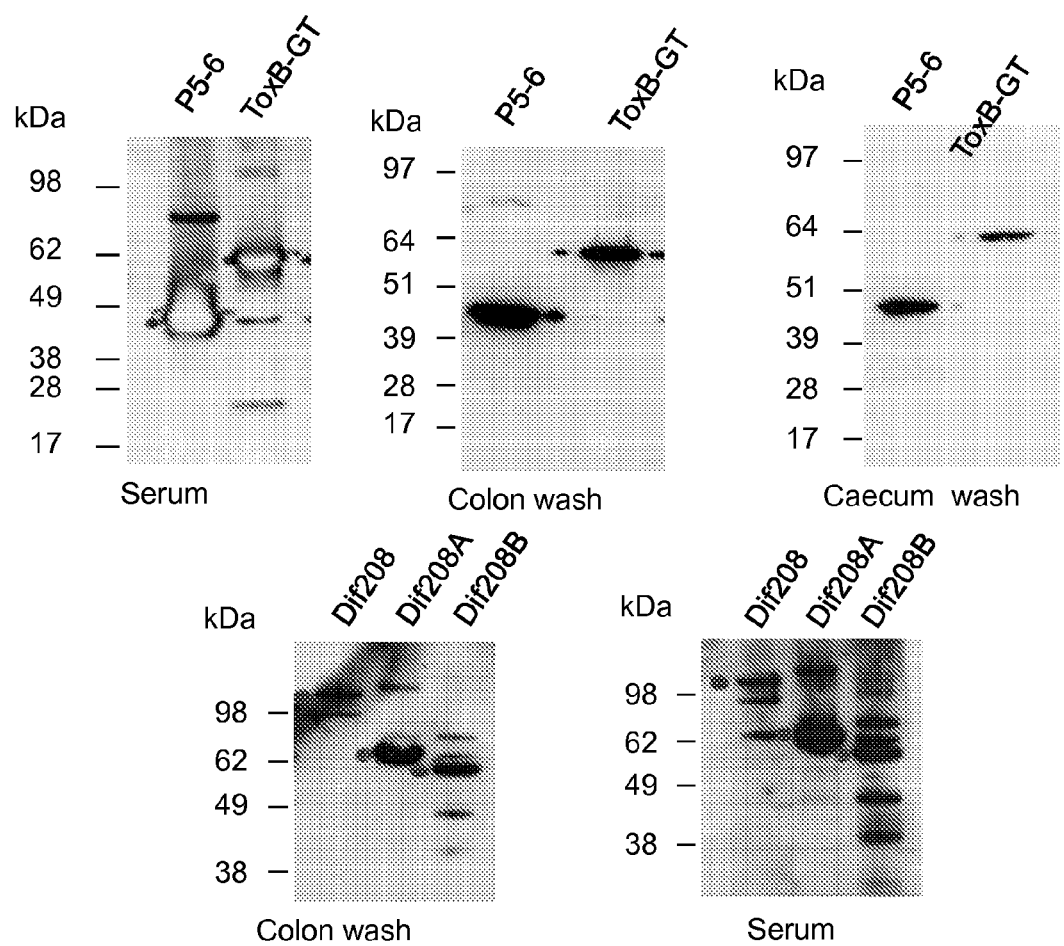

FIG. 29: Shows the recognition of recombinant ToxAp5_6, ToxB_GT and Dif208 by serum or colon and caecum washes from hamsters 6-10 of Example 15.

Figure 30:
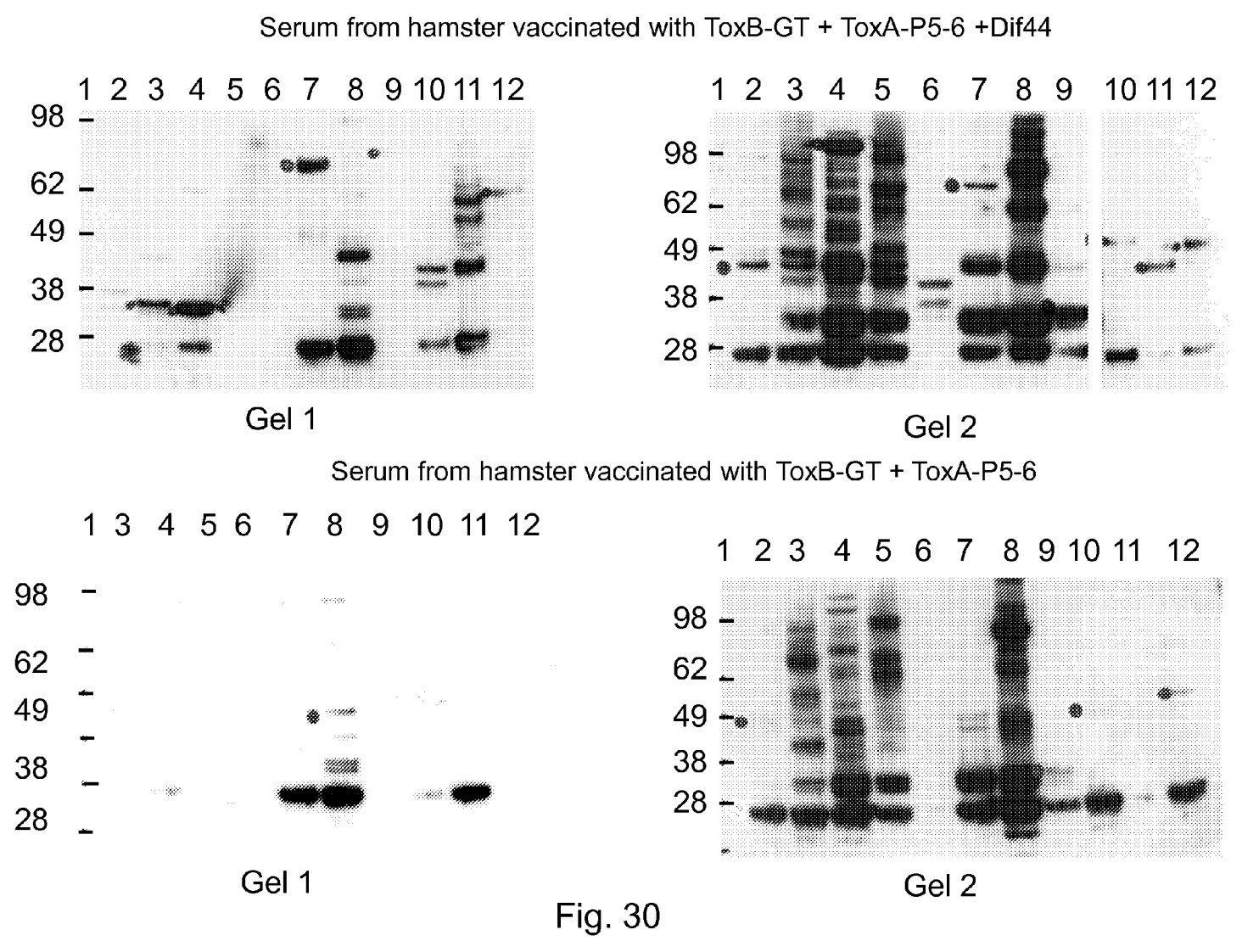

FIG. 30: Shows the recognition of various cell wall proteins (cwps) by serum from hamsters 1-5 of Example 15.

DISCLOSURE OF THE INVENTION

The invention provides polypeptides comprising an amino acid sequence selected from the group consisting of SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465. The polypeptides have been identified from *C. difficile*. Particularly polypeptides of the invention are immunogenic and suitable for use in immunogenic compositions, for instance vaccine compositions.

In one embodiment, the polypeptides of the invention are summarized below and also in FIG. 1.

Dif44: This protein is also known as "CD0844" and is annotated as cell surface protein cwp25 from *C. difficile*. The nucleic acid sequences and amino acid sequences of the polypeptide corresponds with the sequences presented in SEQ ID NO: 78 and 138 and SEQ ID NO: 79 and 139 respectively.

Dif51: This protein is also known as "CD0999" and is annotated as ABC transporter substrate binding protein lipoprotein from *C. difficile*. The nucleic acid sequences and amino acid sequences of the polypeptide corresponds with the sequences presented in SEQ ID NO: 80 and 140 and SEQ ID NO: 81 and 141 respectively. The nucleic acid sequence and amino acid sequence of the polypeptide wherein the N-terminal cysteine has been deleted corresponds with the sequences presented in SEQ ID NO: 356 and 357 respectively.

Dif130: This protein is also known as "CD2645" and is annotated as putative extracellular solute binding protein from *C. difficile*. The nucleic acid sequences and amino acid sequences of the polypeptide are presented in SEQ ID NO: 92 and 152 and SEQ ID NO: 93 and 153 respectively. The nucleic acid sequence and amino acid sequence of the polypeptide wherein the N-terminal cysteine has been deleted corresponds with the sequences presented in SEQ ID NO: 358 and 359 respectively.

Dif153: This protein is also known as CD2830 and is annotated as a hypothetical protein of 220 aminoacids. BLAST analysis showed homology to Anthrax Lethal Factor proteins, a family of zinc metallopeptidases. In particular, Dif153 shows homology to the C-terminal domain of the Anthrax lethal factor. The N-terminal domain of Anthrax, necessary for interaction with the Protective Antigen, is missing. The catalytic site (HEXXH) is conserved (FIG. 17). The nucleic acid sequence and/or amino acid sequence of the polypeptide comprises the sequences presented in SEQ ID NO: 299, 321 and 434 and SEQ ID NO: 300, 322 and 435 respectively. BLAST analysis showed homology to Anthrax Lethal Factor proteins, a family of zinc metallopeptidases. In particular, Dif153 shows homology to the C-terminal domain of the Anthrax lethal factor. The N-terminal domain of Anthrax, necessary for interaction with the Protective Antigen, is missing. The catalytic site (HEXXH) is conserved (FIG. 15). Detoxification of Dif153 may be achieved by mutating the amino acid sequence or the encoding nucleic acid sequence of this polypeptide including a deletion of all or a portion of the zincin metalloprotease domain and a point mutation in zincin metalloprotease domain which reduces the protease activity. Examples of single mutants of Dif153 (CD2830) are H142A, E143A, E143R, H146A, D149A, H150A, Y178F and C208S. Examples of double mutants of Dif153 (CD2830) are H142A/H146A; H142A/Y178F; H142A/E143R; H142A/E143A; E142A/Y178F relative to the wild-type CT153 (CD2830) polypeptide sequence of SEQ ID NO: 300 and 435. The invention provides also other mutants for the CT153 (CD2830) polypeptide alone or in combination: H142A/H150A and E143A/D149A. The foregoing detoxified immunogenic polypeptides preferably retain at least one epitope or immunogenic fragment of SEQ ID NO: 300 and 435. Nucleic acid sequences and amino acid sequences related to these mutants are summarized in

TABLE 1

| Dif153 mutations | Nucleic acid SEQ ID NO: | Amino acid SEQ ID NO: | Primers SEQ ID NO: |
|---|---|---|---|
| Dif153 WT | 434 | 435, 300 | |
| Dif153 E143A | 436 | 437 | 472 & 473 |
| Dif153 H150A | 438 | 439 | |
| Dif153 Y178F | 440 | 441 | |
| Dif153 C208S | 442 | 443 | |
| Dif153 H142A | 444 | 445 | 466 & 467 |
| Dif153 H146A | 446 | 447 | 468 & 469 |
| DIF153 D149A | 462 | 463 | |
| DIF153 E143R | 464 | 465 | |
| Dif153 H142A, H146A | 448 | 449 | |
| Dif153 H142A/E143A | 450 | 451 | |
| Dif153 H142A/E143R | 452 | 453 | |
| Dif153 H142A/Y178F | 454 | 455 | |
| Dif153 E143A/Y178F | 456 | 457 | |
| Dif153 H142A/H150A | 458 | 459 | |
| Dif153 E143A/D149A | 460 | 461 | |

Dif183: This protein is also known as "CD3669" and is annotated as hypothetical protein from *C. difficile*. The C-terminus contains one copy of the GerMN domain that has been implicated in both sporulation and germination in *Bacillus subtilis* (FIG. 20) The nucleic acid sequences and amino acid sequences of the polypeptide are presented in SEQ ID NO: 186, 188, 187 and 189 respectively. The nucleic acid sequence and amino acid sequence of the polypeptide wherein the N-terminal cysteine has been deleted corresponds with the sequences presented in SEQ ID NO: 359 and 360 respectively.

Dif192: This protein is also known as "CD1035" and is annotated as cell surface protein (putative Nacetylmuramoyl-L-alanine amidase) cwp16 from *C. difficile*. The nucleic acid sequences and amino acid sequences of the polypeptide are presented in SEQ ID NO: 104 and 164 and SEQ ID NO: 105 and 165 respectively.

Dif208: This protein is also known as "CD2831" and is annotated as a collagen-binding protein sortase substrate from *C. difficile*. The nucleic acid sequences and amino acid sequences of the polypeptide are presented in SEQ ID NO: 132 and 432 and SEQ ID NO: 133 and 433 respectively. The fragment Dif208A corresponds to amino acids 32-480 of Dif208. The nucleic acid sequences and amino acid sequences of the polypeptide Dif208A are presented in SEQ ID NO: 110 and 170 and SEQ ID NO: 111 and 171 respectively. The fragment Dif208B corresponds to amino acids 481-938 of Dif208. The nucleic acid sequences and amino acid sequences of the polypeptide Dif208B are presented in SEQ ID NO: 112 and 172 and SEQ ID NO: 113 and 173 respectively.

Dif232: This protein is also known as "CD1031" and is annotated as cell wall anchored protein from *C. difficile*. The nucleic acid sequences and amino acid sequences of the polypeptide are presented in SEQ ID NO: 124 and 184 and SEQ ID NO: 125 and 185 respectively.

Particularly preferred polypeptides of the invention are Dif44 and Dif208. These polypeptides have been shown to reduce colonisation of the gut by *C. difficile* in vivo, and are of particular use in immunotherapeutic compostions.

Generally, the polypeptides of the invention are polypeptides for use in medicine and in therapy, particularly in relation to the field of *C. difficile*, for example in passive immunisation against *Clostridium difficile* Associated Disease (CDAD). The invention also provides the use of such polypeptides in the manufacture of a medicament.

In a particular embodiment, the polypeptides of the invention are polypeptides for use in preventing, treating or reducing the severity of a *C. difficile* infection in a mammal. In some embodiments, the invention also provides the use of such compositions in the manufacture of a medicament.

The polypeptides of the invention and referred to above, particularly Dif44 and Dif208 have surprisingly been shown to reduce colonisation of the gut by *C. difficile*, when tested in an in vivo model (Example 15). This is particularly relevant to the prevention of spore induce disease relapse, which is one of the most significant clinical issues in *C. difficile* infection. Experimental vaccines which provide a protective effect against *C. difficile* have not previously been shown to reduce colonisation of the gut by *C. difficile* to the same extent as combinations of antigens which include the polypeptides of the invention and referred to above, particularly Dif44 and Dif208.

The inventors have shown that reduced gut colonisation is observed when the subjects are administered a combination of antigens that elicit a protective effect against *C. difficile* in combination with either Dif44 or Dif208, and subsequently challenged with *C. difficile*. This effect is seen in terms of the amount of *C. difficile* that is shed in faeces at various time points following challenge, or the amount of *C. difficile* that is recovered from gut washes or tissue at the experimental endpoint. Gut colonisation is reduced in subjects that are administered a combination of antigens that elicit a protective effect against *C. difficile* in combination with either Dif44 or Dif208, and subsequently challenged with *C. difficile*, compared to subjects that are administered a combination of antigens that elicits a protective effect against *C. difficile* and subsequently challenged with *C. difficile*.

The polypeptides of the invention and referred to above, particularly Dif44 and Dif208, are thus of particular use in the treatment, prevention or reduction in the severity of *C. difficile* spore induced disease relapse, or in the treatment, prevention or the reduction of colonisation of the gut by *C. difficile*. "Reducing" means causing a decrease, preferably a statistically significant decrease, in a parameter. Reduction of colonization of the gut by *C. difficile* thus refers to causing a decrease in the number of *C. difficile* bacteria present in the gut of a subject at a particular time point after exposure of the subject to *C. difficile*, e.g. 1, 2, 3, 4, 5, 6, 7 days, weeks or months after exposure of the subject to *C. difficile*. The reduction is e.g. in comparison to a subject which has not been administered with the polypeptides, compositions or vaccines of the invention, in comparison with a subject that has been administered a composition that elicits a protective effect against *C. difficile* (which preferably does not contain one or more of Dif44, Dif51, Dif130, Dif153, Dif183, Dif192, Dif208, Dif208A, and Dif232, particularly which does not contain DIF44 or DIF208), and/or in comparison with a subject which has not been administered with any composition that elicits a protective effect against *C. difficile*. The reduction may be at least 10, 20, 30, 40 50, 60, 70, 80, 90, 100%.

The polypeptides of the invention thus can be used e.g. in immunogenic compositions, vaccines, and medical methods as referred to herein, but are particularly useful when they are used in combination with one or more additional antigens, preferably which provide a protective effect against *C. difficile*, or against CDAD.

A protective effect against *C. difficile* or CDAD is observed where administration of the relevant compound (e.g. an antigen or combination of antigens) prevents and/or decreases the likelihood, duration or severity of a subsequent infection or the disease. This can be tested for using methods which are well known in the art, for example those in which the relevant compound is administered to a subject and the subject is challenged with *C. difficile*. The effect of the challenge is observed e.g. in terms of the percentage of animals which survive challenge, and this value can be compared to the value obtained using an appropriate control, e.g. in the absence of administering any compound, or any compound offering a protective effect.

Examples of *C. difficile* antigens which provide a protective effect against *C. difficile* or CDAD are, for example those disclosed in WO2013/084071, the contents of which are incorporated herein by reference. Assays such as those described in WO2013/084071 can thus be used to determine whether a given compound has such a protective effect. In particular, the full length *C. difficile* Tox A (or TcdA) antigen, in combination with the full length *C. difficile* Tox B antigen is said to be a gold standard and thus may serve as a positive control for a protective effect. An antigen that provides a protective effect is thus at least 50, 60, 70, 80, 90, 95 or 100% as effective as this gold standard.

Preferred *C. difficile* antigens and combinations thereof which provide a protective effect against *C. difficile* or or against CDAD are disclosed in WO2013/084071. These antigens are referred to also as *C. difficile* toxin antigens. The immunogenic composition of the invention preferably further comprises one or more additional antigens, preferably which provide a protective effect against *C. difficile*, or against CDAD. More preferably the additional antigens are *C. difficile* toxin antigens. The immunogenic composition of the invention preferably further comprises (a) at least one ToxB-GT antigen and (b) at least one TcdA antigen. Preferably, the ToxB-GT antigen and/or the TcdA antigen is/are detoxified.

Thus the preferred immunogenic compositions of the invention comprise a combination of *C. difficile* antigens, said combination comprising (a) one or more polypeptide selected from the group consisting of Dif44, Dif51, Dif130, Dif153, Dif183, Dif192, Dif208, Dif208A, and Dif232; (b) at least one ToxB-GT antigen and (c) at least one TcdA antigen, and preferably comprising a combination of *C. difficile* antigens, said combination comprising (a) at least one polypeptide selected from the group consisting of Dif44 and Dif208; (b) at least one ToxB-GT antigen and (c) at least one TcdA antigen. "Combination" as used here means a divalent, trivalent or multivalent combination of antigens. A combination is preferably capable of eliciting a protective response, and/or treating, preventing or reducing colonisation of the gut by *C. difficile*. When combinations are used, the individual components may be administered sequentially, simultaneously or separately.

In some embodiments, the ToxB-GT antigen is a polypeptide that comprises, consists essentially of or consists of an amino acid sequence: (a) having 80% or more identity to SEQ ID NO:18 or SEQ ID NO: 60; and/or b) that is a fragment of at least 7 consecutive amino acids of SEQ ID NO:18 or SEQ ID NO: 60, or of a polypeptide having 80% or more identity to SEQ ID NO:18 or SEQ ID NO: 60 and that comprises an epitope of SEQ ID NO:18 or SEQ ID NO: 60. Preferably the ToxB-GT antigen comprises, consists essentially of or consists of SEQ ID NO: 18.

In some embodiments, the TcdA antigen is a polypeptide that comprises or consists of an amino acid sequence: (a) having 80% or more identity to SEQ ID NO:1; and/or b) that is a fragment of at least 7 consecutive amino acids of SEQ ID NO:1, or of a polypeptide having 80% or more identity to SEQ ID NO:1 and that comprises an epitope of SEQ ID NO:1.

In certain embodiments, the immunogenic composition will comprise or further comprise a ToxB-GT antigen and 1, 2, 3, 4, 5, 6, 7, 8, 9, 10, 11, 12, 13, 14, 15 or more TcdA antigens, e.g. 1-10, 1-5, 1-4, 1-3, 1-2, 2-9, 3-8, 4-7, 5-6 TcdA antigens. Preferably, the one or more TcdA antigens are selected from (1) a ToxA-ED antigen (SEQ ID NO: 3), (2) a ToxA-GT antigen (SEQ ID NO: 4), (3) a ToxA-CP antigen (SEQ ID NO:5), (4) a ToxA-T antigen (SEQ ID NO: 6), (5) a ToxA-T4 antigen (SEQ ID NO: 7), (6) a ToxA-B antigen (SEQ ID NO: 8), (7) a ToxA-PTA2 antigen (SEQ ID NO: 9), (8) a ToxA-P5-7 antigen (SEQ ID NO: 10), (9) a ToxA-P5-6 antigen (SEQ ID NO: 11), (10) a ToxA-P9-10 antigen (SEQ ID NO: 12), (11) a ToxA-B2 antigen (SEQ ID NO: 13), (12) a ToxA-B3 antigen (SEQ ID NO: 14), (13) a ToxA-B5 antigen (SEQ ID NO: 15), (14) a ToxA-B6 antigen (SEQ ID NO: 16) or a full-length TcdA antigen (SEQ ID NO:1). More preferably the TcdA antigen is a ToxA-P5-6 antigen which comprises, consists essentially of or consists of SEQ ID NO: 11. As discussed elsewhere herein the one or more TcdA antigens preferably (a) has 80% or more identity to these sequences, and/or (b) is a fragment of at least 7 consecutive amino acids of one or more of these sequences or of a polypeptide having 80% or more identity to one or more of these sequences and comprises an epitope of the relevant sequence.

In certain embodiments, the immunogenic composition will comprise or further comprise a ToxA-GT antigen and 1, 2, 3, 4, 5, 6, 7, 8, 9 or more TcdB antigens, e.g. 1-10, 1-5, 1-4, 1-3, 1-2, 2-9, 3-8, 4-7, 5-6 TcdA antigens optionally selected from (1) a ToxB-ED antigen (SEQ ID NO: 17), (2) a ToxB-GT antigen (SEQ ID NO: 18), (3) a ToxB-CP antigen (SEQ ID NO:19) (4) a ToxB-T antigen (SEQ ID NO: 20), (5) a ToxB-B antigen (SEQ ID NO: 21), (6) a ToxB-B2 antigen (SEQ ID NO: 22) (7) ToxB-B7 (SEQ ID NO: 23) or (8) a full-length TcdB antigen (SEQ ID NO:2). Preferably, the one or more TcdB antigen is a ToxB-GT antigen, particularly an antigen which comprises, consists essentially of or consists of SEQ ID NO: 18.

In particular embodiments, the immunogenic composition comprises or further comprises a ToxB-GT antigen and a TcdA antigen, wherein the TcdA antigen is selected from the group consisting of ToxA-P5-6 and ToxA-B2. More particularly, the TcdA antigen is ToxA-P5-6. Yet more particularly the ToxA-P5-6 antigen will comprise, consist essentially or consist of an amino acid sequence: (a) having 80% or more identity to SEQ ID NO: 11; and/or b) that is a fragment of at least 7 consecutive amino acids of SEQ ID NO: 11, or of a polypeptide having 80% or more identity to SEQ ID NO: 11 and that comprises an epitope of SEQ ID NO: 11.

ToxB-GT Antigens

The full-length TcdB antigen (also referred to herein as ToxB and ToxinB) comprises the amino acid sequence of SEQ ID NO: 2 (encoded by the nucleic acid sequence of SEQ ID NO: 31). Detoxified TcdB antigen is referred to herein as Toxoid B. The abbreviation "ToxB-GT" refers to the glucosyl transferase domain of TcdB, which is located within the N-terminal region of the enzymatic domain (ED) (and represented in FIG. 22). The ToxB-GT domain (SEQ ID NO: 18, encoded by the nucleic acid sequence of SEQ ID NO: 47) is a fragment of TcdB that corresponds to amino acids 1-543 of SEQ ID NO: 2.

The ToxB-GT antigen included in the compositions of the invention is a polypeptide that comprises or consists of an amino acid sequence: (a) having 50% or more identity (e.g. 60%, 65%, 70%, 75%, 80%, 85%, 90%, 91%, 92%, 93%, 94%, 95%, 96%, 97%, 98%, 98.5%, 99%, 99.5%, 99.8%, 99.9%, or more) to SEQ ID NO: 18; and/or (b) that is a fragment of at least "n" consecutive amino acids of SEQ ID NO: 18, or of a polypeptide having 50% or more identity to SEQ ID NO:18, wherein "n" is 7 or more (e.g. 8, 10, 12, 14, 16, 18, 20, 25, 30, 35, 40, 45, 50, 60, 70, 80, 90, 100, 150, 250, 300, 400, 500, 540, or more). Preferred fragments comprise an epitope of SEQ ID NO: 18. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 18 while retaining at least one epitope of SEQ ID NO:18. Amino acid fragments of ToxB-GT may thus comprise an amino acid sequence of e.g. up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, or up to 540, consecutive amino acid residues of SEQ ID NO: 18.

The ToxB-GT antigen included in the compositions of the invention may be detoxified. Detoxification may be achieved by mutating the amino acid sequence or the encoding nucleic acid sequence of the wild-type ToxB-GT antigen using any appropriate method known in the art e.g. site-directed mutagenesis. Preferably, the ToxB-GT antigen comprises one or more amino acid substitutions (i.e. 1, 2, 3, 4, 5, 6, 7, 8, 9, 10, 11, 12, 13, 14, 15, 16, 17, 18, 19, 20, 25, 30, or more mutations), relative to the wild-type ToxB-GT antigen sequence of SEQ ID NO:18. For example, the ToxB-GT antigen comprises one or more amino acid substitutions (i.e. 1, 2, 3, 4, 5, 6, 7, 8, 9, 10, 11, 12, 13, 14, 15, 16, 17, 18, 19, 20, 21, 22, 23, 24, 25, or more mutations), e.g. at amino acid positions 17, 102, 139, 269, 270, 273, 284, 286, 288, 384, 449, 444, 445, 448, 449, 450, 451, 452, 455, 461, 463, 472, 515, 518, and/or 520, relative to the wild-type ToxB-GT antigen sequence of SEQ ID NO:18. For example, the ToxB-GT antigen may comprise substitutions at 1, 2, 3, 4 or 5 positions corresponding to amino acids 270, 273, 284, 286 and/or 288 of the Tox-GT antigen sequence of SEQ ID NO: 18. In particular, 1, 2, 3, 4 or 5 amino acids at positions corresponding to amino acids 270, 273, 284, 286 and/or 288 of the ToxB-GT antigen sequence of SEQ ID NO:18 may be substituted, preferably by alanine residues. The amino acid sequence of a detoxified ToxB-GT antigen having alanine substitutions at these positions is provided in SEQ ID NO: 60.

Where the ToxB-GT comprises two amino acid substitutions, the substitutions are preferably not at amino acid positions 102 and 278, or amino acid positions 102 and 288, of the ToxB-GT antigen sequence of SEQ ID NO:18. The detoxified ToxB-GT antigen included in the compositions of the invention may thus be a polypeptide that comprises or consists of an amino acid sequence: (a) having 50% or more identity (e.g. 60%, 65%, 70%, 75%, 80%, 85%, 90%, 91%, 92%, 93%, 94%, 95%, 96%, 97%, 98%, 98.5%, 99%, 99.5%, 99.8%, 99.9%, or more) to SEQ ID NO: 60; and/or (b) that is a fragment of at least "n" consecutive amino acids of SEQ ID NO: 60, or of a polypeptide having 50% or more identity to SEQ ID NO: 60, wherein "n" is 7 or more (e.g. 8, 10, 12, 14, 16, 18, 20, 25, 30, 35, 40, 45, 50, 60, 70, 80, 90, 100, 150, 250, 300, 400, 500, 540, or more). Amino acid fragments of detoxified ToxB-GT may thus comprise an amino acid sequence of e.g. up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, or up to 540, consecutive amino acid residues of SEQ ID NO: 60. Preferred fragments comprise an epitope of SEQ ID NO: 60. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 60 while retaining at least one epitope of SEQ ID NO 60.

ToxA-GT Antigens

The full-length TcdA antigen (also referred to herein as ToxA and Toxin A) comprises the amino acid sequence of SEQ ID NO: 1 (encoded by the nucleic acid sequence of SEQ ID NO: 30). Detoxified TcdA antigen is referred to herein as Toxoid A. The abbreviation "ToxA-GT" refers to the glucosyl transferase domain of TcdA, which is located within the N-terminal region of the enzymatic domain (ED). The ToxA-GT domain (SEQ ID NO: 4, encoded by the nucleic acid sequence of SEQ ID NO: 33) is a fragment of TcdA that corresponds to amino acids 1-541 of SEQ ID NO: 1.

The ToxA-GT antigen included in the compositions of the invention is a polypeptide that comprises or consists of an amino acid sequence: (a) having 50% or more identity (e.g. 60%, 65%, 70%, 75%, 80%, 85%, 90%, 91%, 92%, 93%, 94%, 95%, 96%, 97%, 98%, 98.5%, 99%, 99.5%, 99.8%, 99.9%, or more) to SEQ ID NO: 4; and/or (b) that is a fragment of at least "n" consecutive amino acids of SEQ ID NO: 4, or of a polypeptide having 50% or more identity to SEQ ID NO:4, wherein "n" is 7 or more (e.g. 8, 10, 12, 14, 16, 18, 20, 25, 30, 35, 40, 45, 50, 60, 70, 80, 90, 100, 150, 250, 300, 400, 500, 540, or more). Preferred fragments comprise an epitope of SEQ ID NO: 4. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 4 while retaining at least one epitope of SEQ ID NO:4.

Amino acid fragments of ToxA-GT may thus comprise an amino acid sequence of e.g. up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, or up to 540, consecutive amino acid residues of SEQ ID NO: 4.

The ToxA-GT antigen included in the compositions of the invention may be detoxified. Detoxification may be achieved by mutating the amino acid sequence or the encoding nucleic acid sequence of the wild-type ToxA-GT antigen using any appropriate method known in the art e.g. site-directed mutagenesis. Preferably, the ToxA-GT antigen comprises one or more amino acid substitutions (i.e. 1, 2, 3, 4, 5, 6, 7, 8, 9, 10, 11, 12, 13, 14, 15, 16, 17, 18, 19, 20, 25, 30, or more mutations), relative to the wild-type ToxA-GT antigen sequence of SEQ ID NO:4. For example, the ToxA-GT antigen may comprise substitutions at 1, 2 or 3 positions corresponding to amino acids 283, 285 and 287 of the ToxA-GT antigen sequence of SEQ ID NO:4. In particular, 1, 2, or 3 amino acids at positions corresponding to amino acids 283, 285 and 287 of the ToxA-GT antigen sequence of SEQ ID NO:4 may be substituted, preferably by alanine residues. The amino acid sequence of a detoxified ToxA-GT antigen having alanine substitutions at these positions is provided in SEQ ID NO: 56.

Where the ToxA-GT antigen comprises one amino acid substitution, the substitution is preferably not at amino acid position 278 of the ToxA-GT antigen sequence of SEQ ID NO: 4. Where the ToxA-GT antigen comprises two amino acid substitutions, the substitutions are preferably not at amino acid positions 101 and 278, of the ToxA-GT antigen sequence of SEQ ID NO:4. Where the ToxA-GT antigen comprises three amino acid substitutions, the substitutions are preferably not at amino acid positions 101, 278 and 519, or amino acid positions 101, 287 and 519, of the ToxA-GT antigen sequence of SEQ ID NO:4.

The detoxified ToxA-GT antigen included in the compositions of the invention may thus be a polypeptide that comprises or consists of an amino acid sequence: (a) having 50% or more identity (e.g. 60%, 65%, 70%, 75%, 80%, 85%, 90%, 91%, 92%, 93%, 94%, 95%, 96%, 97%, 98%, 98.5%, 99%, 99.5%, 99.8%, 99.9%, or more) to SEQ ID NO: 56; and/or (b) that is a fragment of at least "n" consecutive amino acids of SEQ ID NO: 56, or of a polypeptide having 50% or more identity to SEQ ID NO: 56, wherein "n" is 7 or more (e.g. 8, 10, 12, 14, 16, 18, 20, 25, 30, 35, 40, 45, 50, 60, 70, 80, 90, 100, 150, 250, 300, 400, 500, 540, or more). Preferred fragments comprise an epitope of SEQ ID NO: 56. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NO: 56 while retaining at least one epitope of SEQ ID NO: 56. Amino acid fragments of detoxified ToxB-GT may thus comprise an amino acid sequence of e.g. up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, or up to 540, consecutive amino acid residues of SEQ ID NO: 56.

TcdA antigen: The TcdA antigen is a polypeptide that comprises or consists of an amino acid sequence: (a) having 80% or more identity to SEQ ID NO:1; and/or b) that is a fragment of at least 7 consecutive amino acids of SEQ ID NO:1, or of a polypeptide having 80% or more identity to SEQ ID NO:1 and that comprises an epitope of SEQ ID NO:1. Further TcdA antigens, include (1) a ToxA-ED antigen (SEQ ID NO: 3), (2) a ToxA-GT antigen (SEQ ID NO: 4), (3) a ToxA-CP antigen (SEQ ID NO:5), (4) a ToxA-T antigen (SEQ ID NO: 6), (5) a ToxA-T4 antigen (SEQ ID NO: 7), (6) a ToxA-B antigen (SEQ ID NO: 8), (7) a ToxA-PTA2 antigen (SEQ ID NO: 9), (8) a ToxA-P5-7 antigen (SEQ ID NO: 10), (9) a ToxA-P5-6 antigen (SEQ ID NO: 11), (10) a ToxA-P9-10 antigen (SEQ ID NO: 12), (11) a ToxA-B2 antigen (SEQ ID NO: 13), (12) a ToxA-B3 antigen (SEQ ID NO: 14), (13) a ToxA-B5 antigen (SEQ ID NO: 15), (14) a ToxA-B6 antigen (SEQ ID NO: 16) or a full-length TcdA antigen (SEQ ID NO:1), represented in FIG. 22.

Preferred polypeptides for use with the invention comprise an amino acid sequence: (a) having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NOs:1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465, e.g. 90% identity or more, or 95% identity or more, or 99% identity or more; and/or (b) comprising a fragment of at least 'n' consecutive amino acids of SEQ ID NOs:, wherein 'n' is 7 or more (e.g. 8, 10, 12, 14, 16, 18, 20, 25, 30, 35, 40, 50, 60, 70, 80, 90, 100, 150, 200, 250 or more; e.g. 20 or more; or e.g. 50 or more; or e.g. 80 or more). These polypeptides include variants of SEQ ID NOs: 1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465. Preferred fragments of (b) comprise an epitope from SEQ ID NOs:1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NOs: 1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465 while retaining at least one epitope of SEQ ID NO:1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465. Amino acid fragments of polypeptides of the invention may thus comprise an amino acid sequence of e.g up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, up to 550, up to 600, up to 650, up to 700, consecutive amino acid residues of SEQ ID NOs: 1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 or 465. Other fragments omit one or more polypeptide domains. For example, a natural leader peptide and/or sortase recognition sequence may be omitted. As discussed elsewhere, preferred polypeptides that inhibit gut colonisation by *C. difficile* are Dif44 and Dif208 (ie SEQ ID NOS: 79, 139, 133 and 433, as well as SEQ ID NOs 111, 171, 113 and 173 relating to 208A and 208B fragments). Preferred *C. difficile* toxin antigens are ToxB_GT (SEQ ID NOS 18 and 60) and ToxA_p5-6 (SEQ ID NO 11).

The term "polypeptide" or "protein" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labelling component. Also included are, for example, polypeptides containing one or more analogs of an amino acid (including, for example, unnatural amino acids, etc.), as well as other modifications known in the art. Polypeptides can occur as single chains or associated chains.

Polypeptides of the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.). For instance, a polypeptide of the invention may not have an N-terminal cysteine. The invention provides also a polypeptide wherein the N-terminal cysteine has been deleted (e.g. Dif51 (SEQ ID NO: 357), Dif130 (SEQ ID NO: 359) and Dif183 (SEQ ID NO: 361)). A polypeptide of the invention may not have an anchor domain (e.g. Dif208 (SEQ ID NO: 433), DIf208B (SEQ ID NO: 173) and Dif232 (SEQ ID NO: 185).

In some embodiments, the degree of sequence identity is greater than 50%, 60%, 70%, 80%, 90%, 95%, 99% or more (e.g. to the sequences referred to herein and present in the sequence listing). These polypeptides include homologs, orthologs, allelic variants and functional mutants. Typically, 50% identity or more between two polypeptides is considered to be an indication of functional equivalence. Identity between proteins may be determined by the Smith-Waterman homology search algorithm as implemented in the MPSRCH program (Oxford Molecular), using an affine gap search with parameters gap open penalty=12 and gap extension penalty=1.

In another embodiment fragments of the polypeptides of the invention may be used. The fragments should comprise at least n consecutive amino acids from the sequences and, depending on the particular sequence, n is 10 or more (e.g. 12, 14, 16, 18, 20, 30, 40, 50, 60, 70, 80, 90, 100 or more). The fragments may thus comprise an amino acid sequence of e.g. up to 30, up to 40, up to 50, up to 60, up to 70, up to 80, up to 90, up to 100, up to 125, up to 150, up to 175, up to 200, up to 250, up to 300, up to 350, up to 400, up to 450, up to 500, up to 640, or up to 1105 consecutive amino acid residues. The fragments may thus comprise an amino acid sequence of e.g. less then 30, less then 40, less then 50, less then 60, less then 70, less then 80, less then 90, less then 100, less then 125, less then 150, less then 175, less then 200, less then 250, less then 300, less then 350, less then 400, less then 450, less then 500, less then 640, or less then 1105 consecutive amino acid residues. In certain embodiments amino acid fragments may include polypeptides comprising an amino acid sequence of no more than 50, no more than 60, no more than 75, no more than 100, no more than 150, no more than 200, no more than 250, no more than 300, no more than 350, no more than 400 amino acid residues.

Preferred fragments comprise an epitope or are immunogenic fragments. Particularly the fragments may comprise one or more epitopes from the sequence. Other fragments are (a) the N-terminal signal peptides of the polypeptide of the invention, (b) the polypeptide of the invention, but without their N-terminal signal peptides, and (c) the polypeptide of the invention, but without their N-terminal amino acid residue. In particular, the invention provides the fragments Dif208A (CD2831) and Dif208B (CD2831). The amino sequences for these fragments are summarized in FIG. 1.

As used herein the term "fragment" refers to a sequence that is a subset of another sequence. When used in the context of a nucleic acid or amino acid sequence the terms "fragment" and "subsequence" are used interchangeably. These terms are used to refer to a part or portion of an intact or complete wild-type polypeptide but which comprise fewer amino acid residues than an intact or complete wild-type polypeptide. Thus, the term refers to truncated or shorter amino acid sequences corresponding to one or more regions of a wild-type or reference polypeptide. One example of a fragment is an epitope sequence. A fragment or subsequence of an amino acid sequence can be any number of residues that is less than that found in the naturally occurring, or reference, polypeptide. Where the invention concerns an "epitope", this epitope may be a B-cell epitope and/or a T-cell epitope. Such epitopes can be identified empirically (e.g. using PEPSCAN [9,10] or similar methods), or they can be predicted (e.g. using the Jameson-Wolf antigenic index [11], matrix-based approaches [12], MAPITOPE [13], TEPITOPE [14,15], neural networks [16], OptiMer & EpiMer [17, 18], ADEPT [19], Tsites [20], hydrophilicity [21], antigenic index [22] or the methods disclosed in [23-27, etc.]. Epitopes are the parts of an antigen that are recognised by and bind to the antigen binding sites of antibodies or T-cell receptors, and they may also be referred to as "antigenic determinants".

It will be clear to those skilled in the art that, whilst such fragments are truncated or shorter fragments of a reference sequence, such fragments may be modified to comprise additional sequences not found in the reference polypeptide, for example, to form fusion polypeptides, include 'tag' sequences such as His tags or Glutathione S-transferase (GST) tags, linker sequences and the like. Thus, in such modified fragments the amino group of the N terminal amino acid of the fragment is not linked by a peptide bond to the carboxyl group of an amino acid to which it is linked in the reference polypeptide and/or the carboxyl group of the C terminal amino acid of the fragment is not linked by a peptide bond to the amino group of an amino acid to which it is linked in the reference polypeptide.

The percent identity of a first polypeptide and a second polypeptide is generally determined by counting the number of matched positions between the first and second polypeptides and dividing that number by the total length of the shortest polypeptide followed by multiplying the resulting value by 100. For fragments of polypeptides this value is usually around 100% and therefore has little meaning. Therefore, in the context of fragments of the present invention, the term "proportion of reference polypeptide" (expressed as a percentage) is used. Proportion of reference polypeptide is calculated by counting the number of matched positions between the fragment and reference polypeptides and dividing that number by the total length of the reference polypeptide followed by multiplying the resulting value by 100. Particularly, fragments will comprise less than 90, 80, 70, 65, 60, 55, 50, 45, 40, 35, 30, 25 or less than 20% of the sequence of the reference polypeptide.

Polypeptides of use e.g. in the compositions, vaccines and methods of the invention thus may have the sequences recited in the sequence listing, or may be variants and/or fragments thereof, as discussed elsewhere. To the extent that such variants and/or fragments are used, they share the functional properties of the sequences recited in the sequence listing. For example, the variants and/or fragments of the C. difficile toxin sequences referred to in the sequence listing preferably share the ability of polypeptides having the recited sequences to provide a protective effect against C. difficile (e.g. provide a protective effect which is at least 50, 60, 70, 80, 90, 95 or 100% of that shown by the relevant or corresponding C. difficile toxin sequence referred to in the sequence listing). The variants and/or fragments of the C. difficile polypeptides Dif 44, Dif 51, Dif130, Dif153, Dif183, Dif192, Dif208, and Dif232 referred to in the sequence listing preferably share the ability of polypeptides having the recited sequences to reduce colonisation of the gut by C. difficile (e.g. providing a reduction in the colonisation of the gut by C. difficile which is at least 50, 60, 70, 80, 90, 95 or 100% of that shown by the relevant or corresponding C. difficile polypeptide Dif 44, Dif 51, Dif130, Dif153, Dif183, Dif192, Dif208, and Dif232 referred to in the sequence listing).

Polypeptides used with the invention can be prepared by various means (e.g. recombinant expression, purification from cell culture, chemical synthesis, etc.). Generally, the polypeptides of the invention are provided in purified or substantially purified form i.e. substantially free from other polypeptides (e.g. free from naturally-occurring polypeptides), particularly from other C. difficile or host cell polypeptides, and are generally at least about 50% pure (by weight), and usually at least about 90% pure i.e. less than about 50%, and more typically less than about 10% (e.g. 5%) of a composition is made up of other expressed polypeptides. Thus the polypeptides in the compositions are separated from the whole organism with which the molecule is expressed.

In a preferred embodiment, the invention provides a polypeptide comprising, consisting essentially of or consisting of an amino acid sequence selected from the group consisting of SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465 that is immunogenic.

The term "immunogenic" in the context of a polypeptide or protein described herein is used to mean that the antigen or the polypeptide is capable of eliciting an immune response, such as humoral or cellular immune response, and preferably both, against the wild-type *C. difficile* protein from which it is derived, for example, when used to immunise a subject (preferably a mammal, more preferably a human or a mouse). An immunogenic polypeptide is generally referred to as antigenic. A molecule is "antigenic" when it is capable of specifically interacting with an antigen recognition molecule of the immune system, such as an immunoglobulin (antibody) or T cell antigen receptor. An antigenic polypeptide contains an epitope of at least about five, and particularly at least about 10, at least 15, at least 20 or at least 50 amino acids. An antigenic portion of a polypeptide, also referred to as an epitope, can be that portion that is immunodominant for antibody or T cell receptor recognition, or it can be a portion used to generate an antibody to the molecule by conjugating the antigenic portion to a carrier polypeptide for immunization. The skilled person will recognize that a molecule that is antigenic need not be itself immunogenic, for example, some antigens require the presence of an adjuvant or carrier to render them capable of eliciting an immune response.

The term "antigen" refers to a molecule against which a subject can initiate an immune response, eg a humoral and/or cellular immune response. An "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the subject will display either a therapeutic or protective immunological response such that resistance to new infection will be enhanced and/or the clinical severity of the disease reduced. Such protection will be demonstrated by either a reduction of or lack of symptoms normally displayed by an infected subject, a quicker recovery time and/or a lowered pathogen or bacterial load in an infected host. The term "immunogenic" protein or polypeptide as used herein also refers to an amino acid sequence which elicits an immunological response as described above.

Hybrid *C. difficile* Polypeptides

Polypeptides used in the invention may be present in a composition as individual separate polypeptides. Where more than one polypeptide is used, however, they do not have to be present as separate polypeptides. Instead, at least two (e.g. 2, 3, 4, 5, or more) polypeptides can be expressed as a single polypeptide chain (a 'hybrid' polypeptide). Hybrid polypeptides offer two main advantages: first, a polypeptide that may be unstable or poorly expressed on its own can be assisted by adding a suitable hybrid partner that overcomes the problem; second, commercial manufacture is simplified as only one expression and purification need be employed in order to produce two polypeptides which are both antigenically useful. A hybrid polypeptide of at least two polypeptides may also be more immunogenic than one one or more of the at least two polypeptides alone or in simple admixture. The hybrid polypeptide may comprise two or more polypeptide sequences from each of the polypeptides of the invention, or two or more variants of the same polypeptide in the cases in which the sequence has partial variability across strains. Hybrids consisting of amino acid sequences from two, three, four, five, six, seven, eight, nine, or ten polypeptides are useful. In some embodiments, hybrids consisting of amino acid sequences from two, three, four, or five polypeptides are used, such as two or three polypeptides. Different hybrid polypeptides may be mixed together in a single formulation. Hybrids may be combined with non-hybrid polypeptides. Within such combinations, a polypeptide may be present in more than one hybrid polypeptide and/or as a non-hybrid polypeptide. It is typical, however, that a polypeptide is present either as a hybrid or as a non-hybrid, but not as both. The hybrid polypeptides can also be combined with conjugates or non-*C. difficile* polypeptides as described below.

Hybrid polypeptides can be represented by the formula $NH_2$-A-$\{$-X-L-$\}_n$-B—COOH, wherein: X is an amino acid sequence of a *C. difficile* polypeptide, as described above; L is an optional linker amino acid sequence; A is an optional N-terminal amino acid sequence; B is an optional C-terminal amino acid sequence; n is an integer of 2 or more (e.g. 2, 3, 4, 5, 6, etc.). Usually n is 2 or 3. If a —X— moiety has a leader peptide sequence in its wild-type form, this may be included or omitted in the hybrid polypeptide. In some embodiments, the leader peptides will be deleted except for that of the —X— moiety located at the N-terminus of the hybrid polypeptide i.e. the leader peptide of $X_1$ will be retained, but the leader peptides of $X_2 \ldots X_n$ will be omitted. This is equivalent to deleting all leader peptides and using the leader peptide of $X_1$ as moiety -A-. For each n instances of $\{$—X-L-$\}$, linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$COOH, $NH_2X_1$—$X_2$-$L_2$-COOH, etc. Linker amino acid sequence(s) -L- will typically be short (e.g. 20 or fewer amino acids i.e. 20, 19, 18, 17, 16, 15, 14, 13, 12, 11, 10, 9, 8, 7, 6, 5, 4, 3, 2, 1). Examples comprise short peptide sequences which facilitate cloning, poly-glycine linkers (i.e. comprising $Gly_n$ where n=2, 3, 4, 5, 6, 7, 8, 9, 10 or more), and histidine tags (i e. $His_n$ where n=3, 4, 5, 6, 7, 8, 9, 10 or more). Other suitable linker amino acid sequences will be apparent to those skilled in the art. A useful linker is GSGGGG (SEQ ID NO:351) or GSGSGGGG (SEQ ID NO: 352), with the Gly-Ser dipeptide being formed from a BamHI restriction site, thus aiding cloning and manipulation, and the $(Gly)_4$ tetrapeptide being a typical poly-glycine linker. Other suitable linkers, particularly for use as the final $L_n$ are ASGGGS (SEQ ID NO: 353) or a Leu-Glu dipeptide. -A- is an optional N-terminal amino acid sequence. This will typically be short (e.g. 40 or fewer amino acids i.e. 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. $His_n$ where n=3, 4, 5, 6, 7, 8, 9, 10 or more). Other suitable N-terminal amino acid sequences will be apparent to those skilled in the art. If $X_1$ lacks its own N-terminus methionine, -A- is usually an oligopeptide (e.g.

with 1, 2, 3, 4, 5, 6, 7 or 8 amino acids) which provides a N-terminus methionine e.g. Met-Ala-Ser, or a single Met residue. —B— is an optional C-terminal amino acid sequence. This will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g. comprising histidine tags i.e. His$_n$ where n=3, 4, 5, 6, 7, 8, 9, 10 or more), or sequences which enhance protein stability. Other suitable C-terminal amino acid sequences will be apparent to those skilled in the art. Where hybrid polypeptides are used, the individual polypeptides within the hybrid (i.e. individual —X— moieties) may be from one or more strains. Where n=2, for instance, $X_2$ may be from the same strain as $X_1$ or from a different strain of C. difficile. Where n=3, the strains might be (i) $X_1=X_2=X_3$ (ii) $X_1=X_2 \neq X_3$ (iii) $X_1 \neq X_2 = X_3$ (iv) $X_1 \neq X_2 \neq X_3$ or (v) $X_1 = X_3 \neq X_2$, etc.

Within group (c), deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus. N-terminus truncation can remove leader peptides e.g. to facilitate recombinant expression in a heterologous host. C-terminus truncation can remove anchor sequences e.g. to facilitate recombinant expression in a heterologous host. According to the invention, the Xn may comprise the amino acid sequences of two or more antigens selected from the group consisting of: Dif44, Dif51, Dif130, Dif153, Dif183, Dif192, Dif208, Dif208A, Dif232, a ToxB-GT antigen and a TcdA antigen. Each Xn may be an amino acid sequence of an antigen of an antigen combination of the invention (as described above). In certain embodiments, n is 2. When n is 2, X1 is usually a ToxB-GT antigen and X≠2 is usually a TcdA antigen, but any other combination of two of the antigens as described above may also be used in accordance with the invention. When n is 3, for example, any combination of three antigens as described above may be used. When n is 4, for example, any combination of four antigens described above may be used. Generally, two or more of the Xn may be the same antigens or, when n is 2, 3, or 4, each Xn may be a different antigen. When two or more of the Xn are sequences of the same antigen, said two or more Xn may have the same polypeptide sequence or a different polypeptide sequence, e.g., may be different variants or fragments of the given antigen, as described above. Where these antigens are defined in terms of (a) having 50% or more identity (e.g. 60%, 65%, 70%, 75%, 80%, 85%, 90%, 91%, 92%, 93%, 94%, 95%, 96%, 97%, 98%, 99%, 99.5% or more) to a given sequence; and/or (b) comprising a fragment of at least 'n' consecutive amino acids of a given sequence, wherein 'n' is 7 or more (e.g. 8, 10, 12, 14, 16, 18, 20, 25, 30, 35, 40, 50, 60, 70, 80, 90, 100, 150, 200, 250 or more), the level of identity in (a) and the value of 'n' in (b) may be the same for each X.

Polypeptides used with the invention may comprise a sequence —P-Q- or -Q-P—, wherein: —P— is an amino acid sequence as defined above and -Q- is not a sequence as defined above i.e. may be provided as fusion proteins. Where the N-terminus codon of —P— is not ATG, but this codon is not present at the N-terminus of a polypeptide, it will be translated as the standard amino acid for that codon rather than as a Met. Where this codon is at the N-terminus of a polypeptide, however, it will be translated as Met. Examples of -Q- moieties include, but are not limited to, histidine tags (i.e. His$_n$ where n=3, 4, 5, 6, 7, 8, 9, 10 or more), maltose-binding protein, or glutathione-S-transferase (GST). Expression of the polypeptides used with the invention may take place in a heterologous host for expression (recombinant expression), such as E. coli. The heterologous host may be prokaryotic (e.g. a bacterium) or eukaryotic. By way of non limiting example, other suitable hosts include Bacillus subtilis, Vibrio cholerae, Salmonella typhi, Salmonella typhimurium, Neisseria lactamica, Neisseria cinerea, Mycobacteria (e.g. M. tuberculosis), yeasts, etc. One skilled in the art will understand that it may be helpful to change codons to optimise expression efficiency in such hosts without affecting the encoded amino acids.

Nucleic Acids

In another embodiment, the invention provides a nucleic acid which encodes an amino acid sequence selected from the group consisting of SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465. SEQ ID NOS 79, 139, 133, 433, 111, 171, 113 and 173 are preferred. Particular nucleic acid sequences are SEQ ID NOs: 78, 80, 92, 104, 110, 112, 124, 132, 138, 140, 152, 164, 170, 172, 184, 186, 188, 356, 358, 360, 432, 434, 436, 438, 440, 442, 444, 446, 448, 450, 452, 454, 456, 458, 460, 462 and 464. SEQ ID NOS 78, 132, 138, 432, 110, 170, 112 and 172 are preferred.

Nucleotide sequences encoding peptides of the antigen combinations may be designed according to the genetic code. Thus, such a nucleotide sequence may encode one or more of SEQ ID NOs: 1, 2, 3, 4, 5, 6, 7, 8, 9, 10, 11, 12, 13, 14, 15, 16, 17, 18, 19, 20, 21, 22, 23, 54, 56, 58, 60, 62, 64 (e.g. encoding ToxB and TcdA molecules), or may comprise one or more of SEQ ID NOs:30, 31, 32, 33, 34, 35, 36, 37, 38, 39, 40, 41, 42, 43, 44, 45, 46, 47, 48, 49, 50, 51, 52, 53, 55, 57, 59, 61, 63, 65, 66, 67, 68, 69.

These nucleic acids are suitable for use in compositions, for instance in vaccines or other immunogenic compositions. The nucleic acids (e.g. combinations of nucleic acids, vectors, or vector combinations), encode polypeptides used with the invention, combinations of polypeptides or hybrid polypeptides used with the invention. Nucleic acids comprising a nucleotide sequence that encodes one or more (e.g., 2, 3 or 4) polypeptides or hybrid polypeptides of the antigen combinations of the invention may be used. A nucleic acid may be, e.g., a vector (e.g. a cloning or expression vector). Nucleic acids (typically DNA) encoding the polypeptides of invention, can be used to give compositions, methods and uses based on nucleic acid immunisation. Nucleic acid immunisation is now a developed field (e.g. see references 28 to 35).

Nucleic acids of the invention that may be used in compositions of the invention are SEQ ID NOs: 78, 80, 92, 104, 110, 112, 124, 132, 138, 140, 152, 164, 170, 172, 184, 186, 188, 356, 358, 360, 432, 434, 436, 438, 440, 442, 444, 446, 448, 450, 452, 454, 456, 458, 460, 462 and 464, and SEQ ID NOs: 30, 31, 32, 33, 34, 35, 36, 37, 38, 39, 40, 41, 42, 43, 44, 45, 46, 47, 48, 49, 50, 51, 52, 53, 55, 57, 59, 61, 63, 65, 66, 67, 68, 69. In addition, nucleic acids comprising nucleotide sequences having sequence identity to such nucleotide sequences may also be used in compositions of the invention. Identity between sequences is preferably determined by the Smith-Waterman homology search algorithm as described above. Such nucleic acids include those using alternative codons to encode the same amino acid. The use of alternative codons may aid expression in the mammal following vaccination.

Nucleic acids comprising nucleotide sequences having 50% or more identity (e.g. 60%, 65%, 70%, 75%, 80%, 85%, 90%, 91%, 92%, 93%, 94%, 95%, 96%, 97%, 98%, 99%, 99.5% or more, e.g. 90% identity or more, or 95% identity or more, or 99% identity or more, to any of the nucleic acids referred to may thus be used. Nucleic acids which can hybridize to the nucleic acids selected from the group comprising SEQ ID NOs: 78, 80, 92, 104, 110, 112, 124, 132, 138, 140, 152, 164, 170, 172, 184, 186, 188, 356, 358, 360, 432, 434, 436, 438, 440, 442, 444, 446, 448, 450, 452, 454, 456, 458, 460, 462 and 464, and SEQ ID NOs: 30, 31, 32, 33, 34, 35, 36, 37, 38, 39, 40, 41, 42, 43, 44, 45, 46, 47, 48, 49, 50, 51, 52, 53, 55, 57, 59, 61, 63, 65, 66, 67, 68, 69 may also be used in a composition of the invention. Hybridization reactions can be performed under conditions of different "stringency". Conditions that increase stringency of a hybridization reaction are widely known and published in the art. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art (e.g. see refs 36, 37, etc.]. In some embodiments, nucleic acid of the invention hybridizes to a target under low stringency conditions; in other embodiments it hybridizes under intermediate stringency conditions; in some embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

In some compositions, fragments of the nucleic acid sequences described above (e.g. fragments of molecules with the specific sequences referred to in the sequence listing, or fragments of the variants defined above by reference to their ability to hybridise with, or by percentage sequence identity with the specific sequences referred to in the sequence listing may be employed. For certain embodiments of the invention, nucleic acids are at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer). For certain embodiments of the invention, nucleic acids are at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter). Nucleic acid fragments preferably encode epitopes of the specific sequences referred to in the sequence listing.

Nucleic acids according to the invention can take various forms (e.g. single stranded, double stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double stranded form. Primers and probes are generally single-stranded, as are antisense nucleic acids. The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids encoding antigens described herein can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides. The invention provides a process for producing nucleic acid encoding antigens described herein, wherein the nucleic acid is synthesised in part or in whole using chemical means. The invention provides vectors comprising nucleotide sequences encoding antigens described herein (e.g. cloning or expression vectors) and host cells transformed with such vectors.

Nucleic Acid Immunisation

The nucleic acid encoding the polypeptide can be expressed in vivo after delivery to a mammal and the expressed polypeptide then stimulates the immune system. The active ingredient will typically take the form of a nucleic acid vector comprising: (i) a promoter; (ii) a sequence encoding the polypeptide, operably linked to the promoter; and optionally (iii) a selectable marker. In some embodiments, the vectors may further comprise (iv) an origin of replication; and (v) a transcription terminator downstream of and operably linked to (ii). In general, (i) & (v) will be eukaryotic and (iii) & (iv) will be prokaryotic. Typical promoters are viral promoters e.g. from cytomegalovirus (CMV). The vector may also include transcriptional regulatory sequences (e.g. enhancers) in addition to the promoter and which interact functionally with the promoter. Vectors may include the immediate-early CMV enhancer/promoter, and may also include CMV intron A. The promoter is operably linked to a downstream sequence encoding a polypeptide, such that expression of the polypeptide-encoding sequence is under the promoter's control. Where a marker is used, it typically functions in a microbial host (e.g. in a prokaryote, in a bacteria, in a yeast). The marker is often a prokaryotic selectable marker (e.g. transcribed under the control of a prokaryotic promoter). For convenience, typical markers are antibiotic resistance genes. The vector is typically an autonomously replicating episomal or extrachromosomal vector, such as a plasmid. The vector usually comprises an origin of replication. Often the origin of replication is active in prokaryotes but not in eukaryotes. Vectors thus can include a prokaryotic marker for selection of the vector, a prokaryotic origin of replication, but a eukaryotic promoter for driving transcription of the polypeptide-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors. The vector may comprise a eukaryotic transcriptional terminator sequence downstream of the coding sequence. This can enhance transcription levels. Where the coding sequence does not have its own, the vector can comprise a polyadenylation sequence, for example the polyadenylation sequence from bovine growth hormone. The vector may comprise a multiple cloning site.

In addition to sequences encoding the polypeptide and a marker, the vector may comprise a second eukaryotic coding sequence. The vector may also comprise an IRES (Internal Ribosome Entry Site) upstream of said second sequence in order to permit translation of a second eukaryotic polypeptide from the same transcript as the polypeptide. Alternatively, the polypeptide-coding sequence may be downstream of an IRES. The vector may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell. Vectors may be delivered in a targeted way. Receptor-mediated DNA delivery techniques are described in, for example, references 38 to 43. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect. Vectors can be delivered using gene delivery vehicles. The gene delivery vehicle can be of viral or non-viral origin (see generally references 44 to 47). Viral-based vectors for delivery of a desired nucleic acid and expression in a desired cell are well known in the art. Exemplary viral-based vehicles include, but are not limited to, recombinant retroviruses (e.g. references 48 to 58), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 59 to 64). Administration of DNA linked to killed adenovirus [65] can also be employed.

Non-viral delivery vehicles and methods can also be employed, including, but not limited to, polycationic condensed DNA linked or unlinked to killed adenovirus alone [e.g. 65], ligand-linked DNA [66], eukaryotic cell delivery vehicles cells [e.g. refs. 67 to 71] and nucleic charge neutralization or fusion with cell membranes. Naked DNA can also be employed. Exemplary naked DNA introduction methods are described in refs. 72 and 73. Liposomes (e.g. immunoliposomes) that can act as gene delivery vehicles are described in refs. 74 to 78. Additional approaches are described in references 79 & 80. Further non-viral delivery suitable for use includes mechanical delivery systems such as the approach described in ref. 80. Moreover, the coding sequence and the product of expression of such can be delivered through deposition of photopolymerized hydrogel materials or use of ionizing radiation [e.g. refs. 81 & 82]. Other conventional methods for gene delivery that can be used for delivery of the coding sequence include, for example, use of hand-held gene transfer particle gun [83] or use of ionizing radiation for activating transferred genes [81 & 82]. Delivery of DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

Nucleic acids are typically provided in purified or substantially purified form i.e. substantially free from other nucleic acids (e.g. free from naturally-occurring nucleic acids), particularly from other *C. difficile* or host cell nucleic acids, generally being at least about 50% pure (by weight), and usually at least about 90% pure. Nucleic acids for use in the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc. The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Typical vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA. The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Antibodies

In another embodiment, there is provided an antibody capable of binding to a polypeptide encoded by an amino acid sequence selected from the group consisting of SEQ ID NOs 1, 2, 3, 4, 5, 6, 7, 8, 9, 10, 11, 12, 13, 14, 15, 16, 17, 18, 19, 20, 21, 22, 23, 54, 56, 58, 60, 62, 64, 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465.

More preferably the group consists of SEQ ID NOS 79, 139, 133, 433, 111, 171, 113 and 173.

The antibodies referred to herein are capable of binding to a polypeptide useful in the invention and thus include antibodies that bind to polypeptides which are variants and/or fragments of the sequences recited above, as discussed elsewhere. Particularly an antibody capable of binding to a polypeptide of the invention is a neutralising antibody. The term neutralising antibody refers to an antibody that can bind to a particular protein, polypeptide or infectious body thereby negating or reducing the effect of said protein, polypeptide or infectious body. More particularly, a neutralising antibody is any antibody that can neutralise or reduce the ability of that pathogen to initiate and/or perpetuate an infection in a host, for example by reducing or limiting growth, tissue attachment, spread, tissue damage and the like.

Antibodies against the *C. difficile* polypeptides of the invention can be used for passive immunisation in the methods discussed above. Thus the invention provides a composition comprising at least one antibody which is capable of binding a polypeptide comprising the amino acid sequences disclosed herein. Combinations of antibodies according to the invention are provided for simultaneous, separate or sequential administration. The invention also provides and immunogenic and pharmaceutical compositions comprising such antibodies. Herein, in the context of the invention, the term "antibody" or "antibodies" comprises the combinations of antibodies of the invention. In particular, the invention provides a combination of antibodies comprising: (a) one or more antibodies selected from the group consisting of an antibody which recognises a Dif44 antigen, a Dif51 antigen, a Dif130 antigen, a Dif153 antigen, a Dif183 antigen, a Dif192 antigen, a Dif208 antigen, a Dif208A antigen and a Dif232 antigen, preferably a Diff44 or Dif208 antigen (b) an antibody which recognises a ToxB-GT antigen and (c) an antibody which recognises a TcdA antigen (preferably ToxA_p5_6). The combination may be present in a composition.

Compositions, comprising antibodies may be used in therapy. The invention also provides the use of antibodies of the invention in medicine and in therapy, e.g. for passive immunisation against CDAD. The invention also provides the use of such antibodies in the manufacture of a medicament. The invention also provides a method for treating a mammal comprising the step of administering an effective amount of an antibody of the invention. As described above for compositions, these methods and uses allow a mammal to be protected against *C. difficile* infection. In particular, antibodies of the invention may be used in methods of treating or preventing infections by *C. difficile*, comprising the step of administering to the mammal an effective amount of a combination of antibodies as described herein, or a composition comprising such a combination. In these methods, the at least two (e.g. 2, 3, or 4) antibodies of the invention may be administered simultaneously, separately or sequentially.

Antibodies of the invention will typically bind specifically to a polypeptide from *C. difficile* e.g. with an affinity of 1 μM, 100 nM, 10 nM, 1 nM, 100 pM or tighter. The term "antibody" includes intact immunoglobulin molecules, as well as fragments thereof which are capable of binding a polypeptide. These include hybrid (chimeric) antibody molecules [84, 85]; F(ab')2 and F(ab) fragments and Fv molecules; non-covalent heterodimers [86, 87]; single-chain Fv molecules (sFv) [88]; dimeric and trimeric antibody fragment constructs; minibodies [89, 90]; humanized antibody molecules [91-93]; and any functional fragments obtained from such molecules, as well as antibodies obtained through non-conventional processes such as phage display. In some embodiments, the antibodies are monoclonal antibodies. Methods of obtaining monoclonal antibodies are well known in the art. In some embodiments the antibodies are humanised or fully-human antibodies.

The invention also provides compositions comprising combinations of antibodies of the invention. For example, compositions are provided comprising a combination of different antibodies which are specific for at least three (i.e. 3, 4, 5, 6, 7, 8, 9, 10, 11 or 12) *C. difficile* antigens according to the antigen combinations of the invention, including variants and immunogenic fragments of any of said antigens, as well as a process for preparing a mixture of a combination of antibodies of the invention, said process comprising a step of mixing antibodies of any of the combinations of antibodies as defined above. For example, the invention provides a process comprising a step of mixing at least two (i.e. 2, 3, or 4) antibodies selected from antibodies which recognise the *C. difficile* polypeptides of the invention and/or an epitope thereof. A process according to the invention for preparing a mixture of antibodies may comprise a further step of formulating the mixture as a medicament. Such processes may further comprise a step of packaging the formulation for storage or distribution as a medicament.

Antibiotics

In certain situations, such as during or following treatment with or administration of antibiotics, the natural balance of the gut flora is disturbed. As a result *C. difficile* can become more prevalent leading to symptoms of infection. Thus, the compositions of the invention may be used in conjunction with antibiotics to treat the underlying condition and simultaneously prevent or treat any *C. difficile* infection.

In one embodiment, the methods comprise administering an effective amount of a composition of the invention followed by administering antibiotics. In an alternative, the method comprises administering antibiotics followed by administering a composition of the invention. In a further alternative, the method comprises administering antibiotics concurrently with administering a composition of the invention. Thus the antibiotic and the effective amount of one or more polypeptides may be administered sequentially, or separately. Typically the antibiotic used in these methods will be one which is suitable for treating the underlying infection, but which is known to be associated with *C. difficile* AAD. Though any antibiotic can cause antibiotic-associated diarrhoea, or one of the more severe *C. difficile* infection associated conditions, the most common causative agents are ampicillin, clindamycin, cephalosporins such as cefpodoxime, and all fluoroquinolones. These methods are thus particularly suited to treatment regimes incorporating an antibiotic known in the art to be frequently linked to *C. difficile* AAD. In some embodiments, therefore, a composition of the invention may further comprise an antibiotic, such as an antibiotic listed above.

Compositions and Medicaments

In another embodiment, the invention provides a composition comprising: (a) one or more polypeptides comprising an amino acid sequence selected from the group consisting of SEQ ID NOs 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187 189, 190, 191, 193, 195, 260, 262, 264, 266, 268, 270, 272, 274, 284, 286, 288, 290, 292, 294, 296, 298, 300, 302, 304, 306, 308, 310, 312, 314, 316, 318, 320, 322, 324, 326, 328, 330, 331, 357, 359, 361, 427, 429, 431, 433, 435, 437, 439, 441, 443, 445, 447, 449, 451, 453, 455, 457; and/or (b) one or more nucleic acids which encode(s) an amino acid sequence selected from the group recited in (a), or one or more nucleic acid sequences wherein the nucleic acid sequence is selected from the group consisting of SEQ ID NOs:70, 72, 74, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 192, 194, 259, 261, 263, 275, 267, 269, 271, 273, 283, 285, 287, 289, 291, 293, 295, 297, 299, 301, 303, 305, 307, 309, 311, 313, 315, 317, 319, 321, 323, 325, 327, 329, 356, 358, 360, 426, 428, 430, 432, 434, 436, 438, 440, 442, 444, 446, 448, 450, 452, 454, 456, 458, 460, 462 and 464 and/or (c) one of more antibodies capable of binding to a polypeptide comprising an amino acid sequence selected from the group recited in (a) or one of more antibodies capable of binding to a polypeptide comprising an amino acid sequence selected from the group recited in (a) wherein the antibody is a neutralising antibody.

In all cases, molecules with sequences SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465 or encoding or binding to molecules with these sequences are preferred, and particularly preferred are molecules with sequences SEQ ID NOs 79, 139, 133, 433, 111, 171, 113 and 173, or encoding or binding to molecules with these sequences.

In a further embodiment the composition of the invention comprises at least one pharmaceutical carrier(s) and/or excipients. Particularly the composition of the invention is a pharmaceutical or vaccine composition.

In another embodiment, the invention provides a composition comprising a combination of polypeptides comprising, consisting essentially of or consisting of at least one polypeptides selected from the group consisting of SEQ ID NOs 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187 189, 190, 191, 193, 195, 260, 262, 264, 266, 268, 270, 272, 274, 284, 286, 288, 290, 292, 294, 296, 298, 300, 302, 304, 306, 308, 310, 312, 314, 316, 318, 320, 322, 324, 326, 328, 330, 331, 357, 359, 361, 427, 429, 431, 433, 435, 437, 439, 441, 443, 445, 447, 449, 451, 453, 455, 457, 459, 461, 463 and 465. Particularly such compositions comprising a combination of polypeptides comprising, consisting essentially of or consisting of two or more (i.e. 2, 3 or more) amino acid sequences selected from the group recited above. Particularly preferred compositions may comprise a combination of polypeptides comprising, consisting essentially of or consisting of at least one polypeptide selected from the group consisting of SEQ ID NO: 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465, or the group consisting of SEQ ID NOS 79, 139, 133, 433, 111, 171, 113 and 173. Particularly such preferred composition may comprise a combination of polypeptides comprising, consisting essentially of or consisting of two or more (i.e. 2, 3 or more) amino acid sequences selected from the group consisting of SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465 or the group consisting of SEQ ID NOS 79, 139, 133, 433, 111, 171, 113 and 173.

Preferred compositions of the invention may comprise, consist essentially of or consist of a combination of at least one amino acid sequences encoding at least one polypeptide selected from the group consisting of Dif44 (CD0844), Dif51 (CD0999), Dif130 (CD2645), Dif192 (CD1035), Dif183 (CD3669), DIF153 (CD2830), Dif232 (CD1031), Dif208 (CD2831), and Dif208A. Particularly such preferred compositions comprise a combination of C. difficile polypeptides, more particularly comprising, consisting essentially of or consisting of two or more (i.e. 2, 3, 4) polypeptides selected from the group consisting of of Dif44 (CD0844), Dif51 (CD0999), Dif130 (CD2645), Dif192 (CD1035), Dif183 (CD3669), DIF153 (CD2830), Dif232 (CD1031), Dif208 (CD2831), and Dif208A. Especially preferred are Dif44 (CD0844) and Dif208 (CD2831).

Particular compositions of the invention may comprise, consist essentially of or consist of a combination of: Polypeptide DIF44 (CD0844) and polypeptide DIF192 (CD1035); and/or Polypeptide DIF51 (CD0999) and polypeptide DIF130 (CD2645); and/or Polypeptide DIF232 (CD1031) and polypeptide DIF208 (CD2831); and/or Polypeptide Dif183 (CD3669) and polypeptide DIF225 (CD0438); and/or Polypeptide DIF44 (CD0844) and polypeptide DIF51 (CD0999); and/or Polypeptide DIF130 (CD2645) and polypeptide DIF192 (CD1035); and/or Polypeptide Dif183 (CD3669) and polypeptide DIF153 (CD2830); and/or Polypeptide DIF232 (CD1031) and polypeptide DIF208A (CD2831). Polypeptides Dif44 (CD0844), Dif51 (CD0999), Dif130 (CD2645) and/or Dif192 (CD1035); and/or Polypeptides Dif183 (CD3669), DIF153 (CD2830), Dif232 (CD1031), and/or Dif208 (CD2831); and/or Polypeptides Dif183 (CD3669), DIF153 (CD2830), Dif232 (CD1031), and/or Dif208A (CD2831); and/or Polypeptides DIF44 (CD0844), DIF153 (CD2830), and/or Dif208 (CD2831); and/or Polypeptides DIF44 (CD0844), DIF153 (CD2830), and/or Dif208A (CD2831); and/or Polypeptides Dif51 (CD0999), Dif130 (CD2645), Dif183 (CD3669), DIF192 (CD1035), and/or DIF232 (CD1031); and/or Polypeptide DIF44 (CD000844) and one or more (e.g. 2, 3, 4, 5, 6, 7) or at least 1, 2, 3, 4, 5 or 6 of polypeptides DIF51 (CD0999), DIF130 (CD2645), DIF153 (CD2830), DIF192 (CD1035), DIF208 (CD2831), Dif183 (CD003669) and DIF232 (CD1031), e.g. polypeptide DIF44 and one or more (e.g. 2, 3, 4) or at least 1, 2 or 3 of polypeptides DIF153, DIF192, DIF208, Dif183 and Dif232, e.g. DIF44 and DIF153, DIF44 and DIF192, DIF 44 and DIF208, DIF 44 and Dif183, DIF 44 and DIF232; and/or polypeptide DIF208 (CD2831) and one or more (e.g. 2, 3, 4, 5, 6, 7) or at least 1, 2, 3, 4, 5 or 6 of polypeptides DIF 44 (CD0844), DIF51 (CD0999), DIF130 (CD2645), DIF153 (CD2830), DIF192 (CD1035), Dif183 (CD3669) and DIF232 (CD1031), e.g. polypeptide DIF208 and one or more (e.g. 2, 3, 4) or at least 1, 2 or 3 of polypeptides DIF44, DIF153, DIF192, Dif183 and Dif232, e.g. DIF208 and DIF153, DIF208 and DIF192, DIF208 and Dif183, DIF208 and DIF232; and/or polypeptides DIF44 (CD0844), Dif208 (CD2831), and one or more (e.g. 2, 3, 4, 5, 6) or at least 1, 2, 3, 4 or 5 of DIF51 (CD0999), DIF130 (CD2645), DIF153 (CD2830), DIF192 (CD1035), Dif183 (CD3669) and DIF232 (CD1031), e.g. polypeptides DIF44 (CD0844), Dif208 (CD2831), and one or more (e.g. 2 or 3 or 4) or at least 1 or 2 or 3 of polypeptides DIF153, DIF192, Dif183 and Dif232.

Equivalent combinations or compositions may be made using encoding nucleic acid molecules, and/or antibodies to the recited molecules, such that a combination of nucleic acid molecules encoding the peptide combination referred to can be used, as can a combination of antibodies to the recited molecules in the composition of the invention. Particularly compositions of the invention are immunogenic compositions.

All of the above compositions and combinations of the invention, as discussed above, may additionally comprise one or more additional antigens, e.g. which provide a protective effect against *C. difficile*, or against CDAD, molecules which encode such antigens or molecules (e.g. antibodies) that bind to such antigens. The relevant molecules as well as the sequences for these molecules are provided elsewhere herein.

As such, a preferred composition of the invention may comprise, consist essentially of or consist of a combination of: ToxB-GT and TdcA and at least one polypeptide selected from the group consisting of Dif44 (CD0844), Dif51 (CD0999), Dif130 (CD2645), Dif192 (CD1035), Dif183 (CD3669), DIF153 (CD2830), Dif232 (CD1031) and Dif208 (CD2831), e.g. two or more (i.e. 2, 3, 4) polypeptides selected from the group consisting of Dif44 (CD0844), Dif51 (CD0999), Dif130 (CD2645), Dif192 (CD1035), Dif183 (CD3669), DIF153 (CD2830), Dif232 (CD1031) and Dif208 (CD2831).

All of the above recited combinations of DIF44, DIF51, DIF130, DIF153, DIF192, DIF208, Dif183 and/or DIF232 polypeptides can also be made in combination additionally with ToxB-GT and TcdA, as discussed and defined above. TcdA is selected from ToxA-B, ToxA-PTA2, ToxA-P5-7, ToxA-P5-6, ToxA-P9-10, ToxA-B2, ToxA-B3, ToxA-B5, ToxA-B6 and/or ToxA-B7, and preferred combinations are combinations where TcdA is ToxA-P5-6. Most preferable combinations are (i) ToxB-GT, ToxA-P5-6 and DIF44, (ii) ToxB-GT, ToxA-P5-6 and DIF208, (iii) ToxB-GT, ToxA-P5-6, DIF44 and DIF208.

Examples of such combinations include the following combinations of antigens: Tox-GT+TdcA+Dif208; Tox-GT+TdcA+Dif208A; Tox-GT+TdcA+Dif51; Tox-GT+TdcA+Dif44; Tox-GT+TdcA+Dif130; Tox-GT+TdcA+Dif192; Tox-GT+TdcA+Dif183; Tox-GT+TdcA+Dif153; Tox-GT+TdcA+Dif232.

Thus the invention also provides the following combinations of antigens or of antibodies including antibodies that recognise any of the following combinations of antigens: Tox-GT+TdcA+Polypeptide DIF44 (CD0844) and polypeptide DIF192 (CD1035); and/or Tox-GT+TdcA+Polypeptide DIF51 (CD0999) and polypeptide DIF130 (CD2645); and/or Tox-GT+TdcA+Polypeptide DIF232 (CD1031) and polypeptide DIF208 (CD2831); and/or Tox-GT+TdcA+Polypeptide Dif183 (CD3669) and polypeptide DIF225 (CD0438); and/or Tox-GT+TdcA+Polypeptide DIF44 (CD0844) and polypeptide DIF51 (CD0999); and/or Tox-GT+TdcA+Polypeptide DIF130 (CD2645) and polypeptide DIF192 (CD1035); and/or Tox-GT+TdcA+Polypeptide Dif183 (CD3669) and polypeptide DIF153 (CD2830); and/or Tox-GT+TdcA+Polypeptide DIF232 (CD1031) and polypeptide DIF208A (CD2831); and/or Tox-GT+TdcA+Polypeptides Dif44 (CD0844), Dif51 (CD0999), Dif130 (CD2645) and/or Dif192 (CD1035); and/or Tox-GT+TdcA+Polypeptides Dif183 (CD3669), DIF153 (CD2830), Dif232 (CD1031), and/or Dif208 (CD2831); and/or Tox-GT+TdcA+Polypeptides Dif183 (CD3669), DIF153 (CD2830), Dif232 (CD1031), and/or Dif208A (CD2831); and/or Tox-GT+TdcA+Polypeptides DIF44 (CD0844), DIF153 (CD2830), and/or Dif208 (CD2831); and/or Tox-GT+TdcA+Polypeptides DIF44 (CD0844), DIF153 (CD2830), and/or Dif208A (CD2831); Tox-GT+TdcA+Polypeptides Dif51 (CD0999), Dif130 (CD2645), Dif183 (CD3669), DIF192 (CD1035), and/or DIF232 (CD1031).

TdcA is selected from ToxA-B, ToxA-PTA2, ToxA-P5-7, ToxA-P5-6, ToxA-P9-10, ToxA-B2, ToxA-B3, ToxA-B5, ToxA-B6 and/or ToxA-B7. For example the invention also provides the following combinations of antigens or of antibodies including antibodies that recognise any of the following combinations of antigens: Tox-GT+ToxA-P5-6+Polypeptide DIF44 (CD0844) and polypeptide DIF192 (CD1035); and/or Tox-GT+ToxA-P5-6+Polypeptide DIF51 (C00999) and polypeptide DIF130 (CD2645); and/or Tox-GT+ToxA-P5-6+Polypeptide DIF232 (CD1031) and polypeptide DIF208 (CD2831); and/or Tox-GT+ToxA-P5-6+Polypeptide Dif 183 (CD3669) and polypeptide DIF225 (CD0438); and/or Tox-GT+ToxA-P5-6+Polypeptide DIF44 (CD0844) and polypeptide DIF51 (CD0999); and/or Tox-GT+ToxA-P5-6+Polypeptide DIF130 (CD2645) and polypeptide DIF192 (CD1035); and/or Tox-GT+ToxA-P5-6+Polypeptide Dif183 (CD3669) and polypeptide DIF153 (CD2830); and/or Tox-GT+ToxA-P5-6+Polypeptide DIF232 (CD1031) and polypeptide DIF208A (CD2831); and/or Tox-GT+ToxA-P5-6+Polypeptides Dif44 (CD0844), Dif51 (CD0999), Dif130 (CD2645) and/or Dif192 (CD1035); and/or Tox-GT+ToxA-P5-6+Polypeptides Dif183 (CD3669), DIF153 (CD2830), Dif232 (CD1031), and/or Dif208 (CD2831); and/or Tox-GT+ToxA-P5-6+Polypeptides Dif183 (CD3669), DIF153 (CD2830), Dif232 (CD1031), and/or Dif208A (CD2831); and/or Tox-GT+ToxA-P5-6+Polypeptides DIF44 (CD0844), DIF153 (CD2830), and/or Dif208 (CD2831); and/or Tox-GT+ToxA-P5-6+Polypeptides DIF44 (CD0844), DIF153 (CD2830), and/or Dif208A (CD2831); and/or Tox-GT+ToxA-P5-6+Polypeptides Dif51 (CD0999), Dif130 (CD2645), Dif183 (CD3669), DIF192 (CD1035), and/or DIF232 (CD01031).

Tox-GT+TcdA (preferably ToxA-P5-6) can also be combined with: Polypeptide DIF44 (CD0844) and one or more (e.g. 2, 3, 4, 5, 6, 7) or at least 1, 2, 3, 4, 5 or 6 of polypeptides DIF51 (CD0999), DIF130 (CD2645), DIF153 (CD2830), DIF192 (CD1035), DIF208 (CD2831), Dif183 (CD3869) and DIF232 (CD1031), e.g. polypeptide DIF44 and one or more (e.g. 2, 3, 4) or at least 1, 2 or 3 of polypeptides DIF153, DIF192, DIF208, Dif183, DIF232 e.g. DIF44 and DIF153, DIF44 and DIF192, DIF 44 and DIF208, DIF 44 and Dif183, DIF 44 and DIF232; and/or polypeptide DIF208 (CD2831) and one or more (e.g. 2, 3, 4, 5, 6, 7) or at least 1, 2, 3, 4, 5 or 6 of polypeptides DIF 44 (CD0844), DIF51 (CD0999), DIF130 (CD2645), DIF153 (CD2830), DIF192 (CD1035), Dif183 (CD3669) and DIF232 (CD1031), e.g. polypeptide DIF208 and one or more (e.g. 2, 3, 4) or at least 1, 2 or 3 of polypeptides DIF44, DIF153, DIF192, Dif183, e.g. DIF208 and DIF153, DIF208 and DIF192, DIF208 and Dif183, DIF208 and DIF232; and/or polypeptides DIF44 (CD0844), Dif208 (CD2831), and one or more (e.g. 2, 3, 4, 5, 6) or at least 1, 2, 3, 4 or 5 of DIF51 (CD0999), DIF130 (CD2645), DIF153 (CD2830), DIF192 (CD1035), Dif183 (CD3669) and DIF232 (CD1031), e.g. polypeptides DIF44 (CD0844), Dif208 (CD2831), and one or more (e.g. 2 or 3 or 4) or at least 1 or 2 or 3 of polypeptides DIF153, DIF192, Dif183, DIF232.

Equivalent combinations or compositions may be made using encoding nucleic acid molecules, and/or antibodies that bind to the recited molecules (e.g. that recognise any of the combinations of antigens), such that a combination of nucleic acid molecules encoding the peptide combination referred to can be used, as can a combination of antibodies that bind to the recited molecules (e.g. that recognise any of the combinations of antigens). Immunogenic compositions will in general comprise at least one antigenic protein or antigen. Where DIF208 is referred to, this could be substituted with DIF208A or DIF208B in these combinations.

The compositions of the invention may be used in methods for preventing or treating a C. difficile infection. The invention thus provides a method for raising an immune response in a mammal comprising the step of administering an effective amount of a composition of the invention comprising one or more of the polypeptides described above. The immune response is typically protective and involves antibodies and/or cell-mediated immunity. The invention also provides a method for preventing or treating a C. difficile infection in a mammal comprising the step of administering an effective amount of a composition of the invention. The methods may raise a booster response.

One of the major causes of C. difficile infection is use of antibiotics that disturb the gut flora. Therefore compositions of the invention may be used in treatment regimes with antibiotics to treat both the underlying condition and also to treat or prevent any C. difficile invention. By use of these compositions and methods, the mammal can be protected against C. difficile infection, particularly a nosocomial infection. In some embodiments the C. difficile infection results in one or more of diarrhoea, antibiotic associated diarrhoea (AAD), abdominal pain, fever, leukocytosis, pseudomembranous colitis or toxic megacolon, and said treatment may prevent, reduce or eliminate one or more of these.

In some embodiments, the compositions of the invention are compositions for use in medicine and in therapy, e.g. for passive immunisation against CDAD. The invention also provides the use of such antibodies or compositions in the manufacture of a medicament, preferably for any of the types of treatment referred to herein.

In a further embodiment, the compositions of the invention are compositions for use in preventing or treating a C. difficile infection in a mammal.

In some embodiments, the invention also provides the use of polypeptides, nucleic acids and antibodies of the invention in the manufacture of a medicament, preferably for any of the types of treatment referred to herein.

When said immunogenic compositions prevent, ameliorate, palliate or eliminate disease from an animal then the immunogenic composition may optionally be referred to as a vaccine. The term "vaccine" as used herein refers to a vaccine composition that comprises either purified antigenic determinants, nucleic acids encoding the purified antigenic determinants or fragments thereof, in the absence of the disease-causing organism. Such vaccines may also be referred to as a "sub-unit vaccine". The terms are not intended to encompass "whole-cell vaccines", for example those derived from whole bacterial cells that have been killed and which may contain the antigenic determinants in un-purified form as part of a complex and uncharacterised composition. Thus, in particular embodiments whole-cell vaccines may be excluded or are disclaimed. As used herein, the term "multivalent", means that the vaccine contains structurally similar or 'related' antigenic determinants from at least two strains or isolates, the antigenic determinants being homologues having minor differences between their amino acid sequences.

Thus, compositions of the invention may be useful as vaccines. Vaccines according to the invention may either be prophylactic (i.e. to prevent infection) or therapeutic (i.e. to treat infection), but will typically be prophylactic. The term "protected against infection" means that the immune system of a subject has been primed (e.g. by vaccination) to trigger an immune response and repel the infection. It will be clear to those skilled in the art that a vaccinated subject may thus get infected, but is better able to repel the infection than a control subject. The term "treating" includes both therapeutic treatment and prophylactic or preventative treatment, wherein the object is to prevent or lessen infection. For example, treating may include directly affecting or curing, suppressing, inhibiting, preventing, reducing the severity of, delaying the onset of, reducing symptoms associated with, for example, infection, or a combination thereof. "Preventing" may refer, inter alia, to delaying the onset of symptoms, preventing relapse to a disease, and the like. Treating may also include "suppressing" or "inhibiting" an infection or illness, for example reducing severity, number, incidence or latency of symptoms, ameliorating symptoms, reducing secondary symptoms, reducing secondary infections, prolonging patient survival, or combinations thereof.

The term "antigen" refers to a molecule against which a subject can initiate a humoral and/or cellular immune response. An "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the subject will display either a therapeutic or protective immunological response such that resistance to new infection will be enhanced and/or the clinical severity of the disease reduced. Such protection will be demonstrated by either a reduction or lack of symptoms normally displayed by an infected subject, a quicker recovery time and/or a lowered viral titre in the infected host. The term "immunogenic" protein or polypeptide as used herein also refers to an amino acid sequence which elicits an immunological response as described above.

Compositions may thus be pharmaceutically acceptable. They will usually include components in addition to the antigens e.g. they typically include one or more pharmaceutical carrier(s) and/or excipient(s). A thorough discussion of such components is available in [94]. Compositions may be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 μg/ml) mercurial material e.g. thiomersal-free. Vaccines containing no mercury are more preferred. Preservative-free vaccines are particularly preferred. To improve thermal stability, a composition may include a temperature protective agent. Further details of such agents are provided below.

To control tonicity, it is preferred to include a physiological salt, such as a sodium salt. Sodium chloride (NaCl) is preferred, which may be present at between 1 and 20 mg/ml e.g. about 10±2 mg/ml NaCl. Other salts that may be present include potassium chloride, potassium dihydrogen phosphate, disodium phosphate dehydrate, magnesium chloride, calcium chloride, etc. Compositions will generally have an osmolality of between 200 mOsm/kg and 400 mOsm/kg, preferably between 240-360 mOsm/kg, and will more preferably fall within the range of 290-310 mOsm/kg. Compositions may include one or more buffers. Typical buffers include: a phosphate buffer; a Tris buffer; a borate buffer; a succinate buffer; a histidine buffer (particularly with an aluminium hydroxide adjuvant); or a citrate buffer. Buffers will typically be included in the 5-20 mM range. The pH of a composition will generally be between 5.0 and 8.1, and more typically between 6.0 and 8.0 e.g. 6.5 and 7.5, or between 7.0 and 7.8. The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material. Human vaccines are typically administered in a dosage volume of about 0.5 ml, although a half dose (i.e. about 0.25 ml) may be administered to children.

Compositions of the invention may also comprise one or more immunoregulatory agents. Preferably, one or more of the immunoregulatory agents include one or more adjuvants. The adjuvants may include a TH1 adjuvant and/or a TH2 adjuvant. Adjuvants which may be used in compositions of the invention include, but are not limited to:

mineral salts, such as aluminium salts and calcium salts, including hydroxides (e.g. oxyhydroxides), phosphates (e.g. hydroxyphosphates, orthophosphates) and sulphates, etc. [e.g. see chapters 8 & 9 of ref. 95];

oil-in-water emulsions, such as squalene-water emulsions, including MF59 (5% Squalene, 0.5% Tween 80, and 0.5% Span 85, formulated into submicron particles using a microfluidizer) [Chapter 10 of ref. 95, see also ref. 96-99, chapter 10 of ref. 100 and chapter 12 of ref. 101], complete Freund's adjuvant (CFA) and incomplete Freund's adjuvant (IFA);

saponin formulations [chapter 22 of ref. 95], such as QS21 [102] and ISCOMs [chapter 23 of ref. 95];

virosomes and virus-like particles (VLPs) [103-109];

bacterial or microbial derivatives, such as non-toxic derivatives of enterobacterial lipopolysaccharide (LPS), Lipid A derivatives [110, 111], immunostimulatory oligonucleotides [112-117], such as IC-31™ [118] (deoxynucleotide comprising 26-mer sequence 5'-(IC)$_{13}$-3' (SEQ ID NO: 354) and polycationic polymer polypeptide comprising 1-mer amino acid sequence KLKLLLLLKLK (SEQ ID NO: 355)) and ADP-ribosylating toxins and detoxified derivatives thereof [119-128];

human immunomodulators, including cytokines, such as interleukins (e.g. IL-1, IL-2, IL-4, IL-5, IL-6, IL-7, IL-12 [129, 130], interferons (e.g. interferon-γ), macrophage colony stimulating factor, and tumor necrosis factor;

bioadhesives and mucoadhesives, such as chitosan and derivatives thereof, esterified hyaluronic acid microspheres [131] or mucoadhesives, such as cross-linked derivatives of poly(acrylic acid), polyvinyl alcohol, polyvinyl pyrollidone, polysaccharides and carboxymethylcellulose [132];

microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.);

liposomes [Chapters 13 & 14 of [95, 133-135];

polyoxyethylene ethers and polyoxyethylene esters [136];

PCPP formulations [137 and 138];

muramyl polypeptides, including N-acetyl-muramyl-L-threonyl-D-isoglutamine (thr-MDP), N-acetyl-normuramyl-l-alanyl-d-isoglutamine (nor-MDP), and N-acetylmuramyl-l-alanyl-d-isoglutaminyl-l-alanine-2-(1'-2'-dipalmitoyl-sn-glycero-3-hydroxyphosphoryloxy)-ethylamine MTP-PE); and imidazoquinolone compounds, including Imiquamod and its homologues (e.g. "Resiquimod 3M") [139 and 140].

Compositions and vaccines of the invention may also comprise combinations of aspects of one or more of the adjuvants identified above. For example, the following adjuvant compositions may be used in the invention: (1) a saponin and an oil-in-water emulsion [141]; (2) a saponin (e.g. QS21)+a non-toxic LPS derivative (e.g. 3dMPL) [142]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [143]; (5) combinations of 3dMPL with, for example, QS21 and/or oil-in-water emulsions [144]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of [95[. The use of an aluminium hydroxide and/or aluminium phosphate adjuvant is particularly preferred, and antigens are generally adsorbed to these salts. Calcium phosphate is another preferred adjuvant. Other preferred adjuvant combinations include combinations of Th1 and Th2 adjuvants such as CpG & alum or resiquimod & alum. A combination of aluminium phosphate and 3dMPL may be used (this has been reported as effective in pneumococcal immunisation [145]).

The compositions of the invention may elicit both a cell mediated immune response as well as a humoral immune response. This immune response will preferably induce long lasting (e.g. neutralising) antibodies and a cell mediated immunity that can quickly respond upon exposure to *C. difficile*. Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules. CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function. Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a. Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection. An enhanced immune response may include one or more of an enhanced TH1 immune response and a TH2 immune response. A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. In some embodiments, the enhanced TH1 immune response will include an increase in IgG2a production. A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are typical TH1 adjuvants for use in the invention. A TH2 immune response may include one or more of an increase in one or more of the cytokines associated with a TH2 immune response (such as IL-4, IL-5, IL-6 and IL-10), or an increase in the production of IgG1, IgE, IgA and memory B cells. In some embodiments, the enhanced TH2 immune response will include an increase in IgG1 production. A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are typical TH2 adjuvants for use in the invention.

In some embodiments, the invention includes a composition comprising a combination of a TH1 adjuvant and a TH2 adjuvant. Often, such a composition elicits an enhanced TH1 and an enhanced TH2 response, i.e., an increase in the production of both IgG1 and IgG2a production relative to immunization without an adjuvant. Generally, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone). The immune response may be one or both of a TH1 immune response and a TH2 response. The immune response may provide for one or both of an enhanced TH1 response and an enhanced TH2 response. The enhanced immune response may be one or both of a systemic and a mucosal immune response. The immune response may provide for one or both of an enhanced systemic and an enhanced mucosal immune response. Typically the mucosal immune response is a TH2 immune response. Typically the mucosal immune response includes an increase in the production of IgA.

*C. difficile* infections can affect various areas of the body and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a mammal. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials. Where more than one antigen is included in a composition then two antigens may be present at the same dose as each other or at different doses.

As mentioned above, a composition may include a temperature protective agent, and this component may be particularly useful in adjuvanted compositions (particularly those containing a mineral adjuvant, such as an aluminium salt). As described in reference 146, a liquid temperature protective agent may be added to an aqueous vaccine composition to lower its freezing point e.g. to reduce the freezing point to below 0° C. Thus the composition can be stored below 0° C., but above its freezing point, to inhibit thermal breakdown. The temperature protective agent also permits freezing of the composition while protecting mineral salt adjuvants against agglomeration or sedimentation after freezing and thawing, and may also protect the composition at elevated temperatures e.g. above 40° C. A starting aqueous vaccine and the liquid temperature protective agent may be mixed such that the liquid temperature protective agent forms from 1-80% by volume of the final mixture. Suitable temperature protective agents should be safe for human administration, readily miscible/soluble in water, and should not damage other components (e.g. antigen and adjuvant) in the composition. Examples include glycerin, propylene glycol, and/or polyethylene glycol (PEG). Suitable PEGs may have an average molecular weight ranging from 200-20,000 Da. In one embodiment, the polyethylene glycol can have an average molecular weight of about 300 Da ('PEG-300').

The invention provides a composition comprising: (i) one or more antigen(s) as disclosed above; and (ii) a temperature protective agent. This composition may be formed by mixing (i) an aqueous composition comprising one or more antigen(s) (e.g. 2, 3, 4, 5, 6, 7, 8, 9, 10, 11 or 12 of the antigens of the antigen combination), with (ii) a temperature protective agent. The mixture may then be stored e.g. below 0° C., from 0-20° C., from 20-35° C., from 35-55° C., or higher. It may be stored in liquid or frozen form. The mixture may be lyophilised. The composition may alternatively be formed by mixing (i) a dried composition comprising one or more antigen(s), with (ii) a liquid composition comprising the temperature protective agent. Thus component (ii) can be used to reconstitute component (i).

Combinations with *C. difficile* Saccharide Conjugates

The polypeptides of the invention may be used in combination with, or conjugated to saccharide polypeptides. Thus the invention provides a composition comprising a combination of: (1) one or more polypeptide(s) and/or antibodies and (2) one or more conjugates of a *C. difficile* saccharide and a carrier protein; or one or more polypeptide(s) and/or antibodies conjugated to a *C. difficile* saccharide and optionally a carrier protein. The combination may be used in a method of treating or preventing *C. difficile* infection, or in a method of generating an immune response, as described above.

A conjugate used in component (2) of this combination includes a saccharide moiety and a carrier moiety. The saccharide moiety is from *C. difficile*. The *C. difficile* saccharide may in particular be selected from the PS-I, PS-II and PS-III saccharides described in reference 147. PS-I comprises repeating pentasaccharide units of formula A:

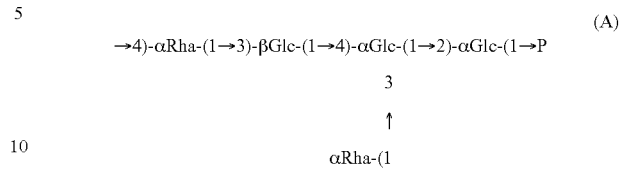

wherein Rha is rhamnose, P is glycosyl phosphate and Glc is glucose.

In particular, the PS-I saccharide used in the present invention may be of formula A':

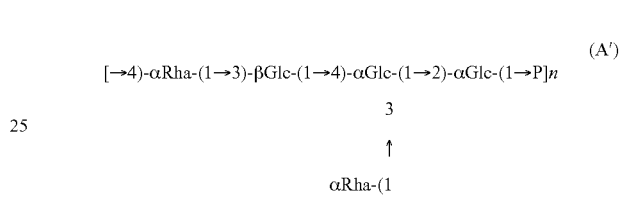

wherein n is an integer from 1 to 1000, Rha is rhamnose, P is glycosyl phosphate and Glc is glucose.

PS-II comprises repeating hexasaccharide units of formula B:

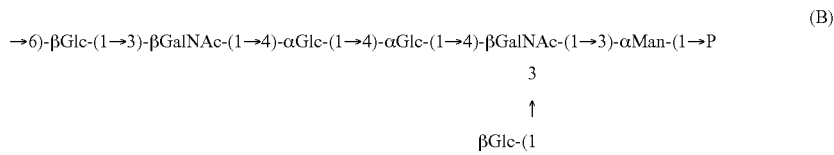

wherein Glc is glucose, GalNAc is N-acetyl-galactosamine, P is glycosyl phosphate and Man is mannose.

In particular, the PS-II saccharide used in the present invention may be of the formula B':

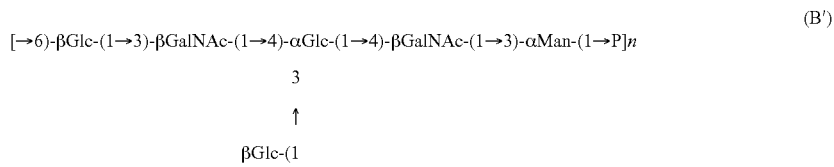

wherein n is an integer from 1 to 1000, Glc is glucose, GalNAc is N-acetyl-galactosamine, P is glycosyl phosphate and Man is mannose.

PS-III comprises glycerol, alditol phosphate, glucose, and N-acetyl-glucosamine within its covalent chemical structure. In the above formulae (A') and (B'), the value of integer n is typically between 1 and 100, e.g. between 2 and 100, between 10 and 100 or between 25 and 100. The carrier moiety in the conjugates used in component (2) will usually be a protein and may or may not be one of the polypeptides of (1). Typical carrier proteins are bacterial toxins, such as diphtheria or tetanus toxins, or toxoids or mutants or fragments thereof. The CRM197 diphtheria toxin mutant [148] is useful. Other suitable carrier proteins include the *N. meningitidis* outer membrane protein complex [149], synthetic peptides [150,151], heat shock proteins [152,153], pertussis proteins [154,155], cytokines [156], lymphokines [156], hormones [156], growth factors [156], artificial proteins comprising multiple human CD4+ T cell epitopes from various pathogen-derived polypeptides [157] such as N19 [158], protein D from *H. influenzae* [159-161], pneumolysin [162] or its non-toxic derivatives [163], pneumococcal surface protein PspA [164], iron-uptake proteins [165], toxin A or B from *C. difficile* [166], recombinant *P. aeruginosa* exoprotein A (rEPA) [167], etc. In some embodiments the carrier protein is a *S. aureus* protein. In other embodiments the carrier is a *C. difficile* polypeptide of the invention.

Where a composition includes more than one conjugate, each conjugate may use the same carrier protein or a different carrier protein. Conjugates may have excess carrier (w/w) or excess saccharide (w/w). In some embodiments, a conjugate may include substantially equal weights of each. The carrier molecule may be covalently conjugated to the carrier directly or via a linker. Direct linkages to the protein may be achieved by, for instance, reductive amination between the saccharide and the carrier, as described in, for example, reference 168. Linkages via a linker group may be made using any known procedure, for example, the procedures described in references 169 and 170. One type of linkage is an adipic acid linker, which may be formed by coupling a free —NH$_2$ group (e.g. introduced to the saccharide by amination) with adipic acid (using, for example, diimide activation), and then coupling a protein to the resulting saccharide-adipic acid intermediate [171,172]. Another type of linkage is a carbonyl linker, which may be formed by reaction of a free hydroxyl group of a saccharide CDI [173, 174] followed by reaction with a protein to form a carbamate linkage. Other linkers include β-propionamido [175], nitrophenyl-ethylamine [176], haloacyl halides [177], glycosidic linkages [178], 6-aminocaproic acid [179], ADH [180], C$_4$ to C$_{12}$ moieties [181], etc. Carbodiimide condensation can also be used [182].

*C. difficile* saccharide polypeptide conjugates may be prepared in various ways e.g. by a process comprising: a) activating the *C. difficile* saccharide by adding a linker comprising a maleimide group to form an activated *C. difficile* saccharide; b) activating the carrier protein by adding a linker comprising a sulphydryl group to form an activated carrier protein; and c) reacting the activated *C. difficile* saccharide and the activated carrier protein to form a *C. difficile* saccharide-carrier protein conjugate; or by a process comprising a) activating the *C. difficile* saccharide by adding a linker comprising a sulphydryl group to form an activated *C. difficile* saccharide; b) activating the carrier protein by adding a linker comprising a maleimide group to form an activated carrier protein; and c) reacting the activated *C. difficile* saccharide and the activated carrier protein to form a *C. difficile* saccharide-carrier protein conjugate; or by a process comprising a) activating the *C. difficile* saccharide by adding a linker comprising a sulphydryl group to form an activated *C. difficile* saccharide; b) activating the carrier protein by adding a linker comprising a sulphydryl group to form an activated carrier protein; and c) reacting the activated *C. difficile* saccharide and the activated carrier protein to form a *C. difficile* saccharide-carrier protein conjugate. These conjugates may be combined with any of the polypeptides disclosed herein.

Additional Antigens

Often, a single composition may be used to provide immunity to a range of infectious agents. Accordingly the composition may comprise antigens not only from *C. difficile*, but also from other bacteria, viruses etc. The invention thus provides a composition comprising one or more polypeptides of the invention and one or more of the following antigens: a protein antigen from *Helicobacter pylori* such as VacA, CagA, NAP, HopX, HopY [183] and/or urease; a protein antigen from *N. meningitidis* serogroup B [184], with protein '287' and derivatives being particularly useful; an outer-membrane vesicle (OMV) preparation from *N. meningitidis* serogroup B, such as those disclosed in 185; a saccharide antigen from *N. meningitidis* serogroup A, C, W135 and/or Y, such as the oligosaccharide disclosed in 186 from serogroup C [see also 187]; a saccharide antigen from *Streptococcus pneumoniae* [188]; an antigen from hepatitis A virus, such as inactivated virus [189]; an antigen from hepatitis B virus, such as the surface and/or core antigens [e.g. 190]; an antigen from hepatitis C virus [e.g. 191]; an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. 192]; a diphtheria antigen, such as a diphtheria toxoid [e.g. 193] e.g. the CRM$_{197}$ mutant [e.g. 194]; a tetanus antigen, such as a tetanus toxoid [e.g. 195]; a saccharide antigen or polypeptide from *Haemophilus influenzae* B; an antigen from *N. gonorrhoeae* [e.g. 196]; an antigen from *Chlamydia pneumoniae* [e.g. 197]; an antigen from *Chlamydia trachomatis* [e.g. 198]; an antigen from *Porphyromonas gingivalis* [e.g. 199]; polio antigen(s) [e.g. 200] such as IPV or OPV; rabies antigen(s) [e.g. 201] such as lyophilised inactivated virus [e.g. 202; RabAvert™]; measles, mumps and/or rubella antigens [e.g. 203]; influenza antigen(s) [e.g. 204], such as the haemagglutinin and/or neuraminidase surface proteins; an antigen from *Moraxella caterrhalis* [e.g. 205]; an antigen from *Staphylococcus aureus* [e.g. 206]; an protein antigen from *Streptococcus agalactiae* (group B *streptococcus*) [e.g. 207, 208]; a saccharide antigen from *Streptococcus agalactiae* (group B *streptococcus*). Particularly, the invention provides a composition comprising one or more polypeptides of the invention and one or more antigens from *Staphylococcus aureus* [e.g. 209].

Methods of Treatment, and Administration of the Vaccine

The invention provides polypeptides, nucleic acids, antibodies or compositions for use in prevention or treatment of infection by *C. difficile* or for the treatment, prevention or reduction in the severity of *C. difficile* spore induced disease relapse, or for the treatment, prevention or the reduction of colonisation of the gut by *C. difficile* in a subject. The subject may be an animal particularly a mammal, more particularly a human, but by way of non-limiting example, may also be an animal of commercial importance such as a cow, a pig, a sheep, a horse or a domestic animal or pet such as a cat, dog, mouse, rat, rabbit, gerbil or hamster. In certain embodiments the subject may be an avian subject such as, for example, a chicken, goose, turkey and the like.

In another embodiment, the invention provides polypeptides, nucleic acids, antibody or composition for use in prevention or treatment of infection by *C. difficile* or for the treatment, prevention or reduction in the severity of *C. difficile* spore induced disease relapse, or for the treatment, prevention or the reduction of colonisation of the gut by *C. difficile* in a subject for sequential, simultaneous or concomitant administration with an antibiotic compound. Particularly the subject is an animal, more particularly a mammal, and yet more particularly a human, for example, an adult or child. Particularly the human is a pregnant woman or a child, particularly a child under ten years of age. The subject may also be a patient receiving broad-spectrum antibiotic treatment with, for example, vancomycin.

In another embodiment the invention provides polypeptides, nucleic acids, antibodies or compositions for use in prevention or treatment of infection by C. difficile or for the treatment, prevention or reduction in the severity of C. difficile spore induced disease relapse, or for the treatment, prevention or the reduction of colonisation of the gut by C. difficile in a human wherein the human is >50 years old and/or suffering from a nosocomial C. difficile infection.

Particularly the invention provides polypeptides, nucleic acids, antibody or composition for use in prevention or treatment of diarrhoea, antibiotic associated diarrhoea (AAD), abdominal pain, abdominal cramping, dehydration, fever, leukocytosis, pseudomembranous colitis or toxic megacolon associated with C. difficile infection.

In a further embodiment the invention provides polypeptides, nucleic acids, antibody or composition for use in prevention or treatment of diarrhoea, antibiotic associated diarrhoea (AAD), abdominal pain, fever, leukocytosis, pseudomembranous colitis or toxic megacolon associated with C. difficile infection for sequential, simultaneous or concomitant administration with an antibiotic compound.

In another embodiment the invention provides the use of a polypeptide, nucleic acid, antibody or composition of the invention in the manufacture of a medicament for preventing or treating a C. difficile infection or for the treatment, prevention or reduction in the severity of C. difficile spore induced disease relapse, or for the treatment, prevention or the reduction of colonisation of the gut by C. difficile in a subject.

In another embodiment the invention provides a method for preventing or treating a C. difficile infection in a mammal or for the treatment, prevention or reduction in the severity of C. difficile spore induced disease relapse, or in the treatment, prevention or the reduction of colonisation of the gut by C. difficile comprising the step of administering (a) at least one polypeptide comprising, consisting essentially or consisting of an amino acid sequence selected from the group consisting of SEQ ID NOs 79, 81, 93, 105, 111, 113, 125, 133, 139, 141, 153, 165, 171, 173, 185, 187, 189, 300, 322, 357, 359, 361, 433, 435, 437, 439, 441, 443, 445, 447, 449, 451, 453, 455, 457, 459, 461, 463 and 465, more preferably selected from the group consisting of SEQ ID NOs 79, 139, 133, 433, 111, 171, 113 and 173, (b) at least one nucleic acid which encodes an amino acid sequence selected from the group recited in (a), and/or (c) at least one antibody capable of binding to an amino acid sequence selected from the group recited in (a), to the subject.

In another embodiment the invention provides a method for preventing or treating a C. difficile infection or for the treatment, prevention or reduction in the severity of C. difficile spore induced disease relapse, or for the treatment, prevention or the reduction of colonisation of the gut by C. difficile in a subject comprising the step of administering at least one nucleic acid selected from the group consisting of 78, 80, 92, 104, 110, 112, 124, 132, 138, 140, 152, 164, 170, 172, 184, 186, 188, 356, 358, 360, 432, 434, 436, 438, 440, 442, 444, 446, 448, 450, 452, 454, 456, 458, 460, 462 and 464 to the subject, preferably selected from the group consisting of SEQ ID NOs: 78, 132, 138, 432, 110, 170, 112 and 172.

In a method for preventing or treating a C. difficile infection or for the treatment, prevention or reduction in the severity of C. difficile spore induced disease relapse, or for the treatment, prevention or the reduction of colonisation of the gut by C. difficile in a subject comprising the step of administering at least one antibody, the antibody is preferably a neutralizing antibody.

As discussed above, combinations of the antigens referred to above with one or more additional antigens which provide a protective effect against C. difficile, or against CDAD are preferred. The combinations and compositions comprising these combinations as disclosed elsewhere herein can thus be used equally in the above methods. Combinations of the antigens referred to above are preferably made with ToxB_GT and TcdA antigens, even more preferably ToxB-GT and ToxAp 5_6 antigens. The methods of the invention thus include methods in which one or more additional antigens which provide a protective effect against C. difficile, or against CDAD are also administered, with preferred such antigens being ToxB-GT and ToxAp 5_6. Nucleotide molecules encoding such antigens may also be used, as may antibodies which bind to such antigens, as discussed elsewhere. In all cases where more than one antigen (or nucleotide molecule or antibody) is used the antigens (or nucleotide molecules or antibodies) may be administered sequentially, simultaneously or separately.

In another embodiment the invention provides a method for preventing or treating a C. difficile infection or for the treatment, prevention or reduction in the severity of C. difficile spore induced disease relapse, or for the treatment, prevention or the reduction of colonisation of the gut by C. difficile in a subject comprising the step of administering a composition of the invention to the subject.

In a further embodiment the invention provides a method for preventing or treating a C. difficile infection or for the treatment, prevention or reduction in the severity of C. difficile spore induced disease relapse, or for the treatment, prevention or the reduction of colonisation of the gut by C. difficile in a subject comprising the step of administering a composition of the invention to the subject wherein the composition comprises at least one pharmaceutical carrier(s) and/or excipients.

In another embodiment the invention provides a method for preventing or treating a C. difficile infection or for the treatment, prevention or reduction in the severity of C. difficile spore induced disease relapse, or for the treatment, prevention or the reduction of colonisation of the gut by C. difficile in a subject comprising the step of administering a composition of the invention to the subject wherein the composition is a pharmaceutical or vaccine composition. The method may be used for raising an immune response, or preventing or treating a C. difficile infection or for the treatment, prevention or reduction in the severity of C. difficile spore induced disease relapse, or for the treatment, prevention or the reduction of colonisation of the gut by C. difficile, in a subject. Methods of the invention may also further comprise administration of an antibiotic.

C. difficile is also known to infect a range of mammals, both wild and domestic. The disease is very similar to that observed in humans, but the heterogeneity of isolates has been observed to be lower [2]. The compositions and methods of the invention thus may be used to treat mammals such as horse, pigs and cows, inter alia, where C. difficile infection has been demonstrated.

In some embodiments the mammal has recently received antibiotics, is currently receiving antibiotics, or is about to receive antibiotics. Particularly preferred mammals are primates, more preferably humans. The human may be a child (e.g. a toddler or infant) a teenager or an adult. A composition intended for children may also be administered to adults e.g. to assess safety, dosage, immunogenicity, etc. The human may be undergoing treatment in hospital.

Vaccines prepared according to the invention may be used to treat both human children and adults. Thus a human may be less than 1 year old, 1-5 years old, 5-15 years old, 15-55 years old, or at least 55 years old. The humans for receiving the vaccines may be elderly (e.g. ≥50 years old, ≥60 years old, and preferably ≥65 years), the young (e.g. ≤5 years old), hospitalised patients, healthcare workers, armed service and military personnel, pregnant women, the chronically ill, or immunodeficient patients. The vaccines are not suitable solely for these groups, however, and may be used more generally in a population.

Vaccines produced by the invention may be administered to humans at substantially the same time as (e.g. during the same medical consultation or visit to a healthcare professional or vaccination centre) other vaccines e.g. at substantially the same time as an influenza vaccine, a measles vaccine, a mumps vaccine, a rubella vaccine, a MMR vaccine, a varicella vaccine, a MMRV vaccine, a diphtheria vaccine, an *S. aureus* vaccine, a tetanus vaccine, a pertussis vaccine, a DTP vaccine, a conjugated *H. influenzae* type b vaccine, an inactivated poliovirus vaccine, a hepatitis B virus vaccine, a meningococcal conjugate vaccine (such as a tetravalent A-C-W135-Y vaccine), a respiratory syncytial virus vaccine, etc.

The invention also provides a kit comprising a composition of the invention. The kit may further comprise one or more of the following: instructions, syringe or other delivery device, adjuvant, antibiotic or pharmaceutically acceptable formulating solution. The invention also provides a delivery device pre-filled with a composition of the invention.

One way of checking efficacy of therapeutic treatment involves monitoring *C. difficile* infection after administration of the compositions of the invention to the mammal. One way of checking efficacy of prophylactic treatment involves monitoring immune responses, systemically (such as monitoring the level of IgG1 and IgG2a production) and/or mucosally (such as monitoring the level of IgA production), against the polypeptides in the compositions of the invention after administration of the composition. Typically, polypeptide-specific serum antibody responses are determined post-immunisation but pre-challenge whereas polypeptide-specific mucosal antibody responses are determined post-immunisation and post-challenge. Another way of assessing the immunogenicity of the compositions of the present invention is to express the proteins recombinantly for screening mammal sera or mucosal secretions by immunoblot and/or microarrays. A positive reaction between the protein and the mammal sample indicates that the mammal has mounted an immune response to the protein in question. This method may also be used to identify immunodominant polypeptides and/or epitopes within polypeptides. The efficacy of vaccine compositions can also be determined in vivo by challenging animal models of *C. difficile* infection, e.g., guinea pigs or mice, with the vaccine compositions.

Compositions of the invention will generally be administered directly to a mammal. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration.

The invention may be used to elicit systemic and/or mucosal immunity, for example to elicit an enhanced systemic and/or mucosal immunity. Typically the enhanced systemic and/or mucosal immunity is reflected in an enhanced TH1 and/or TH2 immune response. Often, the enhanced immune response includes an increase in the production of IgG1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

Strains and Variants

The polypeptides of the invention were originally derived from *C. difficile* strain 630. As such they may be referred to as *C. difficile* antigens However, it will be apparent to one skilled in the art that polypeptides of the invention are useful for immunisation against CDAD caused by multiple different strains of *C. difficile*. Thus, the invention is not limited to compositions comprising polypeptides and/or fragments derived only from the strain 630 and strain SM. Sequences of several strains of *C. difficile* are available, including those of *C. difficile* strains R20291(SM), *C. difficile* strain 196, *C. difficile* strain BI1, *C. difficile* strain BI/NAP1/027 (ribotype 027), *C. difficile* strain M120 and *C. difficile* strain M68, strain 855, strain QCD-63q42, strain ATCC43255.

Standard search and alignment techniques can be used to identify in any further genome sequences the homolog of any particular sequence from the *C. difficile* strain, for example in strain ATCC43255, strain CIP107932, strain QCD-23m63, strain QCD-32g58, strain QCD-37x79, strain 855, strain QCD-63q42, strain QCD-66c26, strain QCD-76w55, strain QCD-97b34, strain CD196, strain CDBI1, strain CDCF5, strain CDSM, strain CDM68, strain CDM120 or strain R20291. Moreover, the available sequences from the present *C. difficile* strain can be used to design primers for amplification of homologous sequences from other strains. Thus the invention is not limited to polypeptides from this strain, but rather encompasses such variants and homologs from other strains of *C. difficile*, as well as non-natural variants. In general, suitable variants of a particular SEQ ID NO include its allelic variants, its polymorphic forms, its homologs, its orthologs, its paralogs, its mutants, etc.

Thus, for instance, polypeptides used with the invention may, compared to the SEQ ID NOs herein, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may also include one or more (e.g. 1, 2, 3, 4, 5, 6, 7, 8, 9, etc.) single amino acid deletions relative to the SEQ ID NO sequences. The polypeptides may also include one or more (e.g. 1, 2, 3, 4, 5, 6, 7, 8, 9, etc.) insertions (e.g. each of 1, 2, 3, 4 or 5 amino acids) relative to the SEQ ID NO sequences.

Similarly, a polypeptide used with the invention may comprise an amino acid sequence that: (a) is identical (i.e. 100% identical) to a sequence disclosed in the sequence listing; (b) shares sequence identity (e.g. 50%, 60%, 70%, 80%, 85%, 90%, 91%, 92%, 93%, 94%, 95%, 96%, 97%, 98%, 99%, 99.5% or more) with a sequence disclosed in the sequence listing; (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and implemented in the needle tool in the EMBOSS package [210] when aligned with a particular sequence from the sequence listing using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [211], using default parameters (e.g. with Gap opening penalty=10.0, and with Gap extension penalty=0.5, using the EBLOSUM62 scoring matrix).

In general, when a polypeptide of the invention comprises a sequence that is not identical to a complete *C. difficile* sequence from the sequence listing (e.g. when it comprises a sequence listing with <100% sequence identity thereto, or when it comprises a fragment thereof) it is preferred in each individual instance that the polypeptide can elicit an antibody which recognises the respective complete *C. difficile* sequence. Where hybrid polypeptides are used, the individual antigens within the hybrid (i.e. individual —X— moieties) may be from one or more strains. Where n=2, for instance, $X_2$ may be from the same strain as $X_1$ or from a different strain. Where n=3, the strains might be (i) $X_1=X_2=X_3$ (ii) $X_1=X_2\neq X_3$ (iii) $X_1\neq X_2=X_3$ (iv) $X_1\neq X_2\neq X_3$ or (v) $X_1=X_3\neq X_2$, etc.

Within group (c), deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus.

In view of the above, the term "*C. difficile* antigen" of "*C. difficile* polypeptide" includes molecules as defined above, e.g. which are variants or homologs from other strains of *C. difficile*, or which are non-natural or non-naturally occurring variants of the polypeptides or antigens referred to herein and/or provided in the sequence listing, and which preferably satisfy the sequence criteria defined above.

The invention also provides polypeptides belonging to the family of zinc mettallopeptidases having mutations that decrease the toxicity of polypeptides. Suitable polypeptides include Dif153 (CD2830). Exemplary mutations that decrease the toxicity include a deletion of all or a portion of the zincin metalloprotease domain and a point mutation in zincin metalloprotease domain which reduces the protease activity. Detoxification may be achieved by mutating the amino acid sequence or the encoding nucleic acid sequence of these polypeptides using any appropriate method known in the art e.g. site-directed mutagenesis. Preferably, the polypeptides belonging to the family of zinc mettallopeptidases comprises one or more amino acid substitutions (i.e. 1, 2, 3, 4, 5, 6, 7, 8, 9, 10, 11, 12, 13, 14, 15, 16, 17, 18, 19, 20, 25, 30, or more mutations), relative to the sequence of the wild type polypeptides belonging to the family of zinc mettallopeptidases. For example, the Dif153 (CD2830) polypeptide comprises one or more amino acid substitutions (i.e. 1, 2, 3, 4, 5, 6, 7, 8, 9, 10, 11, 12, 13, 14, 15, 16, 17, 18, 19, 20, 21, 22, 23, 24, 25, or more mutations), e.g. substitution of amino acid number at amino acid positions 134, 142, 143, 146, 149, 150, 178, 184 and/or 208 relative to the wild-type Dif153 (CD2830) polypeptide sequence of SEQ ID NO: 300 and 435. For example, the Dif153 (CD2830) polypeptide may comprise substitutions at 1, 2, 3, 4 or 5 positions corresponding to amino acids 134, 142, 143, 146, 149, 150, 178, 184 and/or 208 of the Dif153 (CD2830) polypeptide sequence of SEQ ID NO: 300 and 435. In particular, 1, 2, 3, 4 or 5 amino acids at positions corresponding to amino acids 134, 142, 143, 146, 149, 150, 178, 184 and/or 208 relative to the wild-type Dif153 (CD2830) polypeptide sequence of SEQ ID NO: 300 and 435 may be substituted, preferably by alanine (A), phenylalanine (F), arginine (R), serine (S) residues. Examples of single mutants of Dif153 (CD2830) are H142A, E143A, E143R, H146A, D149A, H150A, Y178F and C208S. Examples of double mutants of Dif153 (CD2830) are H142A/H146A; H142A/Y178F; H142A/E143R; H142A/E143A; E142A/Y178F relative to the wild-type CT153 (CD2830) polypeptide sequence of SEQ ID NO: 300 and 435. The invention provides also other mutants for the CT153 (CD2830) polypeptide alone or in combination: H142A/H150A and E143A/D149A. The foregoing detoxified immunogenic polypeptides preferably retain at least one epitope or immunogenic fragment of SEQ ID NO: 300 and 435.

The invention also provides a *C. difficile* bacterium comprising mutations, particularly a *C. difficile* bacterium in which one or more of the polypeptides detailed in the examples has/have been knocked out. Techniques for producing knockout bacteria are well known, and knockout *C. difficile* strains have been reported. A knockout mutation may be situated in the coding region of the gene or may lie within its transcriptional control regions (e.g. within its promoter). A knockout mutation will reduce the level of mRNA encoding the polypeptide to <1% of that produced by the wild-type bacterium, preferably <0.5%, more preferably <0.1%, and most preferably to 0%. The invention also provides a bacterium, such as a *C. difficile* bacterium, that constitutively expresses a polypeptide of the invention. The invention also provides a *Clostridium* bacterium comprising a gene encoding a polypeptide of the invention, wherein the gene is under the control of an inducible promoter. Such bacteria may be useful in testing and development or in the preparation of attenuated vaccines.

General

The practice of the present invention will employ, unless otherwise indicated, conventional methods of chemistry, biochemistry, molecular biology, immunology and pharmacology, within the skill of the art. Such techniques are explained fully in the literature. See, e.g., [212-219]. In some implementations, the term "comprising" refers to the inclusion of the indicated active agent, such as recited polypeptides, as well as inclusion of other active agents, and pharmaceutically acceptable carriers, excipients, emollients, stabilizers, etc., as are known in the pharmaceutical industry. In some implementations, the term "consisting essentially of" refers to a composition, whose only active ingredient is the indicated active ingredient(s), however, other compounds may be included which are for stabilizing, preserving, etc. the formulation, but are not involved directly in the therapeutic effect of the indicated active ingredient. Use of the transitional phrase "consisting essentially" means that the scope of a claim is to be interpreted to encompass the specified materials or steps recited in the claim, and those that do not materially affect the basic and novel characteristic(s) of the claimed invention. See, In re Herz, 537 F.2d 549, 551-52, 190 USPQ 461, 463 (CCPA 1976) (emphasis in the original); see also MPEP § 2111.03. Thus, the term "consisting essentially of" when used in a claim of this invention is not intended to be interpreted to be equivalent to "comprising". The term "consisting of" and variations thereof includes "including" and "limited to" unless expressly specified otherwise. The term "about" in relation to a numerical value x means, for example, x±10%, x±5%, x±4%, x±3%, x±2%, x±1%.

While certain embodiments of the present invention have been described and specifically exemplified above, it is not intended that the invention be limited to such embodiments. Various modifications may be made thereto without departing from the scope and spirit of the present invention as set forth in the following claims.

EXAMPLES

Example 1: Identification of *C. difficile* Polypeptides

In order to identify polypeptides for use in the provision of vaccines against *C. difficile*, the Inventors analysed the whole ensemble of around 3780 predicted polypeptides encoded by *C. difficile* 630 using the PSORT program (220). This identified proteins with a predicted peripheral subcellular localisation. In particular the following groups were identified:

Cell wall associated proteins, identified by the presence of the typical LPXTG-like motif which represents the site of attachment to the protein to the external side of the bacterial cell wall.

Extracellular proteins, identified by the presence of an N-terminal leader peptide that typically directs the protein products to the extra cellular milieu, and/or by sequence similarity to other bacterial proteins known to be exported.

Proteins with a bacterial surface location.

Other polypeptides were selected for their sequence homology to known virulence factors and polypeptide motifs involved in the interaction with the host. Several polypeptides of unknown function have also been identified. The polypeptides were then tested and screened using the methodology described in the following examples:

Example 2: Identification of Secreted *C. difficile* Polypeptides

*Clostridium difficile* secretome preparation was performed as followed: *C. difficile* (strains 630 and Stoke Mandeville) was grown both in Brain Heart Infusion (BHI) or Chemically Defined Medium (CDM, M. N. Mickelson, *J. of Bact.*, 1964, 88:158-164). Bacteria were plated over-night on agar plate and then grown in 100 mL of appropriate medium under anaerobic condition at 37° C. until mid-Log phase ($OD_{600}$ of 0.5) or early stationary phase ($OD_{600}$ of 0.9) was reached. Bacteria were removed by centrifugation at 3,500×g for 10 min at 4° C. and the supernatant was filtered through a 0.22 μm pore size filter (Millipore). Proteins present in the supernatant were precipitated o/n with 10% w/v trichloroacetic acid, 0.04% w/v sodium deoxycholate. Proteins were resuspended in 50 mM ammonium bicarbonate containing 5 mM dithiothreitol, 0.1% Rapigest® (Waters), heated at 90° C. for 10 min and digested o/n with 2 ug of trypsin (Promega). Proteolitic digestion was stopped adding 0.1% v/v formic acid. Resulting peptides were subsequently analyzed by mass spectrometry.

Protein identification by nano-LC/MS/MS was performed as followed: peptides were separated by nano-LC on a NanoAcquity UPLC system (Waters) connected to a Q-ToF Premier Electro Spray Ionization (ESI) mass spectrometer equipped with a nanospray source (Waters). Samples were loaded onto a NanoAcquity 1.7 μm BEH130 $C_{18}$ column (75 μm×25 cm, Waters) through a NanoAcquity 5 μm Symmetry® $C_{18}$ trap column (180 μm×20 mm, Waters). Peptides were eluted with a 120-min gradient of 2-40% of 98% acetonitrile, 0.1% formic acid solution at 250 nl/min flow rate.

The eluted peptides were subjected to an automated data-dependent acquisition using the MassLynx software, version 4.1 (Waters), in which a MS survey scan was used to automatically select multicharged peptides over the m/z ratio range of 300-2,000 for further MS/MS fragmentation. Up to five different components were subjected to MS/MS fragmentation at the same time. After data acquisition, individual MS/MS spectra were combined, smoothed, and centroided using ProteinLynx, version 3.5 (Waters), to obtain the peak list file. The Mascot Daemon application (MatrixScience Ltd., London, UK) was used for the automatic submission of data files to a version of MASCOT (version 2.2.1) running on a local server.

Protein identification was achieved by searching in a locally curated database combining protein sequence data derived from the *Clostridium difficile* section of the NCBInr database, the total number of sequences and residues being 71233 and 21677396, respectively. The MASCOT search parameters were set to (i) 1 as number of allowed missed cleavages for trypsin digestion, (ii) methionine oxidation and glutamine and asparagine deamidation as variable modifications, (iii) 0.2 Da as peptide tolerance, and (iv) 0.2 Da as MS/MS tolerance. Only significant hits were considered, as defined by the MASCOT scoring and probability system. The score thresholds for acceptance of peptide identification were a 33 for trypsin digestion.

The Inventors discovered that the polypeptides Dif183, Dif192, and Dif153 were secreted and present in the supernatant derived from strain 630. In addition, the Inventors discovered that the following proteins were present in the supernatant of the 20291 strain: Dif183, Dif192, and Dif153 and the fragments Dif208A and Dif208B. These results are summarized in FIG. 2. These secreted proteins/polypeptides are useful vaccine targets particularly for use in the reduction or prevention of bacterial colonization or for use in reducing tissue damage such as necrosis at the site of infection.

Example 3: Analysis of the Cell Lysate by NMR

Bacterial cells carrying vectors for recombinant protein expression were initially washed by resuspension in 800 uL M9 1× buffer, pH 7.4, centrifuged (5' at 3,000 rpm), and supernatant discarded. The remaining bacterial pellet is then resuspended in 600 uL M9 buffer, cells are lysed by means of sonication, and then centrifuged at 4° C. (20' @14,000 rpm). The supernatant is then isolated for NMR analysis. 10% D2O (by volume) is added to the sample for NMR analysis. Fast HSQC or TROSY experiments were acquired using a 900 or 800 MHz NMR and processed using by topspin software (FIG. 3).

From the NMR analysis, the HSQC spectra for Dif44 showed a good dispersion of the pics with roughly equal intensity in FIG. 4 indicating that Dif44 is well folded. The results for the NMR analysis of the cell lysate are summarized in FIG. 2. These results identified polypeptides having the propensity to stably maintain their three dimensional structure particularly when expressed in a heterologous environment such as the *Escherichia coli* cytoplasm—a useful feature for the provision of a recombinant, sub-unit vaccine component.

Example 4: Cloning, Expression, Purification of Recombinant Proteins and Fragments To prepare isolated, recombinant proteins, *Clostridium difficile* ORFs were PCR-amplified using specific oligonucleotides and *C. difficile* chromosomal DNA as template. The primers used for the gene amplications are summarized in FIG. 1. Resulting PCR products were cloned in pET15b (Novagen) using the PIPE method (Klock, H. E., et al. (2008). *Proteins* 71:982-994), consisting in the PCR amplification of the cloning vector (V-PCR) and in the PCR amplification of the insert (I-PCR). Then, 1 μl of V-PCR and 1 μl of I-PCR are mixed and transformed in chemically competent HK100 cells (Klock, H. E., et al. (2005) *J. Struct. Funct. Genomics* 6, 89-94). I-PCR reactions were set up containing 1 μM each of the forward and reverse primers, 1× Cloned Pfu DNA Polymerase Reaction Buffer, 2.5 units of Pfu Turbo DNA polymerase (Stratagene), 200 μM of each dNTP (Invitrogen) and 50 ng of genomic DNA template. The reactions were conducted as follows: initial denaturation for 2 min at 95° C., then 25 cycles of 95° C. for 30 s, 55° C. for 45 s, and 68° C. for 3 min followed by a final cool down to 4° C. V-PCR reactions were identical to the I-PCR reactions but the steps at 68° C. were lasting 14 min and 2 ng of pET15b plasmid were used as DNA template. Correct transformants where selected by PCR screening and DNA plasmid sequencing of the vector-insert junctions. The correct plasmid were then prepared from selected HK100 clones and used to transform BL21(DE3)T1$^r$ cells (Sigma) in order to allow protein expression.

To express cloned proteins, BL21(DE3)T1$^r$ clones containing pET15b constructs were grown in LB medium containing 100 μg/ml Ampicillin at 37° C. until $OD_{600}$=0.5. Protein expression was then induced by adding 1 mM IPTG and growing at the same temperature for additional 3 hrs. Conventional protein extractions and SDS-Page were performed to check protein expression.

Example 5: Immunization of Mice with *C. difficile* Recombinant Proteins and Fragments For each polypeptide and fragment described in FIG. 1, two groups of 4 female CD1 mice were used. Each group was immunised with 10 μg of antigen, formulated in Alum adjuvant (group 1) or MF59 adjuvant. Immunisations were performed intra-peritoneally at days 0, 21, and 35. Final bleeding and culling was performed at day 49.

Sera against recombinant polypeptides were used in characterizing the polypeptides of the invention by Western Blot, confocal microscopy and FACS analysis described below. The sera was also utilised in passive protection experiments to identify which polypeptides were most suitable for use in the preparation of neutralising antibodies.

Example 6: Surface-Exposure Studies by Western Blot

In order to demonstrate that the selected proteins are surface-expressed by *C. difficile* cells, sera raised against each recombinant protein were used in different screenings. Western blot analysis on bacterial fractions was performed to verify the presence of the polypeptides of the invention in S-layer fractions (containing non-covalently anchored proteins of the cell wall) and in total cell wall extracts (containing all proteins of the cell wall); purified proteins were used as positive control of sera specificity. *C. difficile* 630 strain was grown overnight in BHI medium and harvested by centrifugation for preparation of S-layer and total cell wall extracts. S-layer extracts were prepared using low pH glycine incubation; briefly, bacterial pellet was incubated with 0.2 M-glycine, pH2.2 and protease inhibitors at room temperature for 20 min. The bacterial suspension was centrifuged and the supernatant containing the surface proteins was neutralized by addition of 2 M Tris base.

Total cell wall extracts were prepared by incubation of bacteria with 60 μg/ml mutanolysin, 1 mg/ml lysozyme and protease inhibitors at room temperature for 2 hours. The bacterial suspension was centrifuged and the supernatant containing the surface proteins was collected. Proteins in the S-layer and cell wall extracts were subjected to SDS-PAGE and western blotting. All mouse sera raised against each recombinant protein were used at 1/1000 dilution, followed by anti-mouse-HRP at 1/2500 dilution.

Analysis of Dif183 and Preparation of *C. difficile* cell fractions: To prepare a "total cell extract", strain 630 was grown in TYM to OD600 1,3. Cells were harvested by centrifugation at 4000 rpm for 10 minutes and washed once in PBS. The pellet was resuspended in PBS. In order to isolate the "cell wall fraction", containing the S-layer proteins together with other proteins that are present within the cell wall, strain 630 was grown in 20 ml of TYM broth to OD600 1,3. Cells were harvested by centrifugation at 4000 rpm for 10 minutes at 4° C. and washed once in PBS and once in Tris-sucrose buffer (10 mM Tris-HCl pH6.9, 10 mM MgCl2, 0.5 M sucrose). The pellet was then incubated in 2 ml digestion buffer (Tris-sucrose buffer with 250 μg/ml mutanolysin and protease inhibitors) for 2 h at 37° C. with gentle rotating agitation. The reaction supernatant, containing the "cell wall fraction", was separated by centrifugation from the pellet, containing the "protoplast fraction". Protoplasts were resuspended in PBS and lysis was carried out by freeze-thawing the sample 5 times.

For preparation of the "S-layer fraction", containing only proteins associated to the S-layer, strain 630 was grown in 50 ml of BHIS broth overnight. Cells were separated from the medium by centrifugation at 3500 g for 10 minutes at room temperature, washed in PBS and incubated in 0.5 ml of 0.2 M HCl, pH 2.2 for 20 min at room temperature with gentle agitation, in the presence of protease inhibitors. The bacterial suspension was centrifuged at maximum speed at 4° C. for 10 min. The supernatant, containing the S-layer proteins, was removed and the pH neutralized by addition of 2 M Tris base. For western blot analysis, fractions were normalized based on the starting culture volume.

Western Blot Analysis:

For protein analysis of whole-cell lysates, cell fractions, supernatant fractions and purified recombinant proteins, the samples were mixed with sample buffer containing reducing agent and heated for 10 min at 100° C. prior to loading. The samples were separated by SDS-PAGE using the NuPAGE Gel System (Invitrogen) and transferred onto nitrocellulose membranes for Western blot analysis. The membranes were blocked 3 hours with PBS-10% milk powder at 4° C. Primary antibodies used are polyclonal mouse antisera raised against recombinant his-tagged proteins. All the primary antibodies were diluted 1:1000 and incubated 1 h at 30 min at 37° C.; the secondary antibody was goat anti-mouse serum conjugated to horseradish peroxidase (1:5000; Dako) and was incubated at room temperature for 45 min. Detection of bound antibodies was carried out with Super Signal Chemiluminescent Substrate (Pierce) following the manufacturer's instructions.

The polypeptides Dif44, Dif51 and Dif192, recognized by the sera as shown, are cell surface exposed and accessible to the immune system of a subject and these antigens therefore also represent useful vaccine targets, particularly for the prevention of infection, reducing colonization or spread of infection (FIG. 5).

Example 6A: Surface-Exposure Determination by Confocal Microscopy

In order to determine if selected proteins are surface-expressed by *C. difficile* cells, sera raised against each recombinant protein were used in further screenings. Confocal microscopy on fixed bacteria was performed to evaluate the accessibility of specific antibodies to each predicted exposed protein. Bacterial DNA was labeled with blue-fluorescent DAPI; surface proteins were stained with specific sera followed by secondary antibodies conjugated to a red or green dye.

To verify the surface exposure of each selected polypeptide, *C. difficile* 630 strain was grown in BHI up to $OD_{600}$ 0.5 and washed in PBS. Bacterial pellets were fixed with 2% PFA for 20 min at room temperature and spotted on chamber slides coated with poly-lysine. Bacteria were then blocked with 2% BSA for 15 min and incubated with sera raised against each recombinant protein diluted 1/500 in 2% BSA for 1 hour at room temperature. Bacteria were then stained with goat anti-mouse Alexa Fluor 568 conjugated antibodies (Molecular Probes) for 30 min at RT. Gold antifade reagent with DAPI (Molecular Probes) was then used to mount cover slips.

The inventors found that sera raised against Dif44, Dif51, Dif153, Dif183, Dif192, Dif208, and Dif232 were able to recognize these proteins on the surface of the 630 strain. FIG. 2 in the column entitled confocal microscopy shows the proteins which are surface exposed and detected in *C. difficile* 630 strain extracts. Again, these antigens which may be cell surface exposed and accessible to the immune system represent useful vaccine targets.

Example 7: Interaction with Human Epithelial Cells

To evaluate whether selected polypeptides were able to bind to human epithelial cells, each recombinant polypeptides was tested in two binding assays:

1. FACS analysis: Vero cells were non-enzymatically detached using cell dissociation solution (CDS, Sigma), harvested and suspended in RPMI medium supplemented with 1% FBS. Approximately 10' cells were placed in 96-well microplates and mixed with different concentrations of purified proteins ranging from 500 to 0.24 mg/mL or medium alone for 1 h at 37° C. or at 4° C., mixing every 20 minutes to avoid the attachment of cells. Excess of unbound proteins was removed by washing twice with PBS+2% FBS and centrifugating. Cells were subsequently incubated for 1 h at 4° C. with sera raised against each recombinant polypeptide. Cells were washed twice in PBS+2% FBS and incubated for 30 min at 4° C. with R-Phycoerythrin-conjugated anti-mouse IgG (Jackson ImmunoResearch Laboratories). Cells were subsequently washed in PBS+2% FBS and resuspended in PBS. The inventors found that Dif208A, Dif208B, Dif232, and Dif192 had the ability to bind to the surface of Vero cells. As example, the FACS analysis of Dif232 is shown in FIG. 6 and all the results of the FACS analysis are summarized in FIG. 7. The polypeptides which bind to human cells may be good candidates for limiting or preventing the colonization of *C. difficile*.

2. Confocal microscopy: Vero and Caco-2 cells were seeded on chamber slides in DMEM medium supplemented with 10% FCS and incubated for 24 h. Cells were incubated with 20 mg/mL of each polypeptide diluted in DMEM+10% FCS for 1 h at 37° C. Excess unbound polypeptides were removed by two washings in PBS+2% BSA and cells were fixed with 2% PFA for 20 min at room temperature. Cells were then blocked with PBS+2% BSA for 15 min and incubated with sera raised against each recombinant protein diluted 1/500 in PBS+2% BSA for 1 hour at room temperature. Polypeptides were then stained with anti-mouse Alexa Fluor 488 conjugated antibodies (Molecular Probes) and cellular actin was stained with phalloidin—Alexa Fluor 568 conjugated. Gold antifade reagent with DAPI (Molecular Probes) was then used to mount cover slips.

In order to confirm the FACS results, the polypeptides which were positive for the FACS were tested by confocal microscopy binding assay on Vero cells. Moreover, the analysis was extended to human intestinal Caco-2 cells. The polypeptides which bind to human cells may be good candidates for limiting or preventing the colonization of *C. difficile*. The inventors demonstrated that Dif208B, Dif51 and Dif192 were clearly bound to the cell membrane whereas Dif208A was potentially associated to the cell membrane (FIG. 7). These polypeptides have been demonstrated to bind to human cells and they may be good candidates for limiting or preventing the colonization of *C. difficile*.

Example 8: Interaction to Extracellular Matrix (ECM) Components

Plates were coated with 10 µg/ml of each ECM component and incubated O/N at 4° C. Plates were then washed and blocked with 2.7% for 2 hours at 37° C. After washing, plates were stored at 4° C. for at least 16 hours. 20-50 µg/ml of recombinant polypeptide were added to coated wells and incubated for 2 hours at 37° C.

Wells were washed and incubated with sera raised against each recombinant protein for 90 min at 37° C., followed by incubation with the HRP-conjugated secondary antibody for 90 min at 37° C. HRP substrate solution was added to the wells and the reactions stopped by adding 12.5% $H_2SO_4$. Plates were read at 490 nm by an ELISA plate reader.

The polypeptides which are able to bind to extracellular components may be good candidates for limiting or preventing the colonization of the intestine tissue. For example, Dif208 polypeptide contains an extracellular matrix-binding domain. To verify whether these domains were functional in mediating the binding to specific ECM components, the inventors have performed ELISA studies. ELISA plates were coated with purified ECM components and incubated with serially diluted recombinant proteins ranging from 2 ug to 31.25 ng/well. Two subdomains of Dif208 protein (Dif208A and Dif 208B) were analyzed in this study. The inventors have discovered that Dif208 subdomains bind to all the ECM components (FIG. 9). These polypeptides are able to bind to extracellular components and may be good candidates for limiting or preventing the colonization of the intestine tissue.

Figure 8:
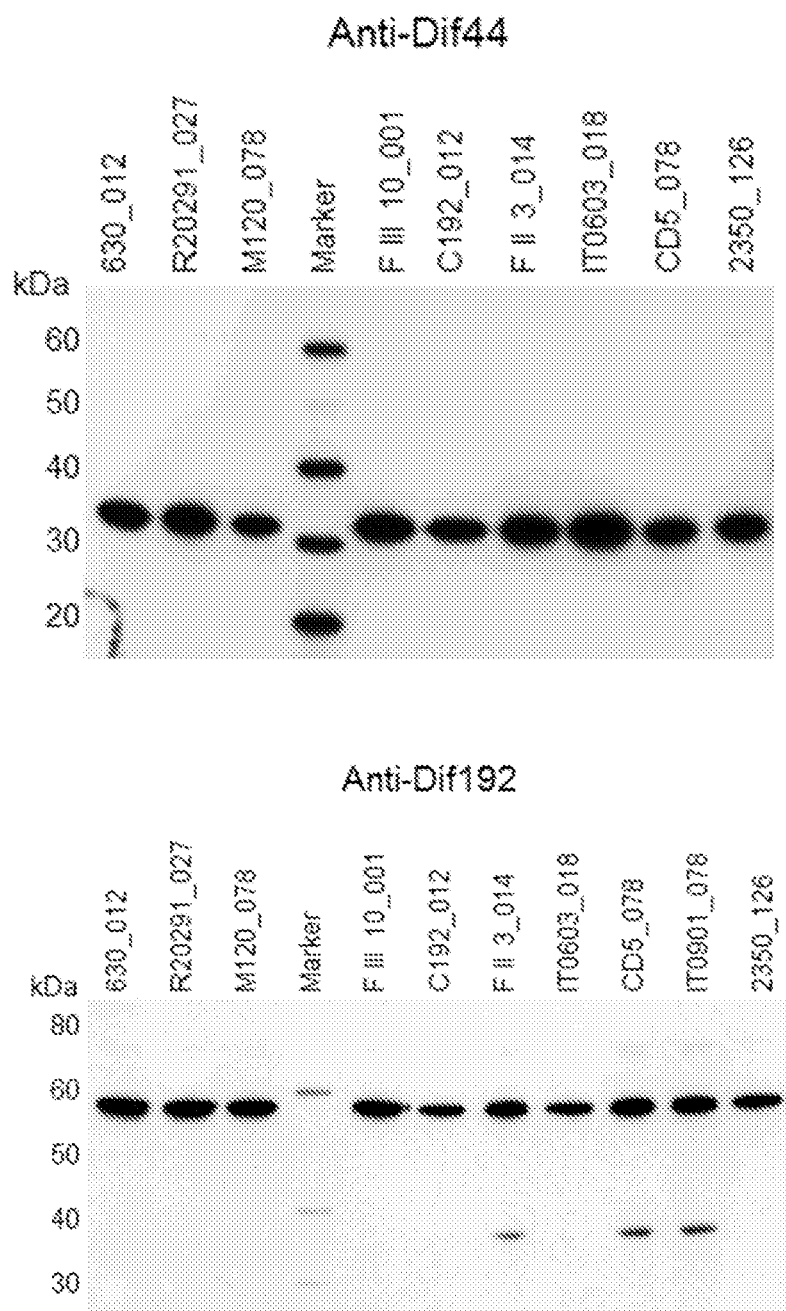

Example 9: Conservation of Dif192, and Dif44 in *C. difficile* Clinical Isolates The presence of Dif192, and Dif44 were studied by Western blot analysis of total cell extracts or S-layer preparations of the *C. difficile* strains 630 (ribotype 012), R20291 (ribotype 027), and M120 (ribotype 078) and *C. difficile* clinical isolates representing 6 of the prevailing PCR-ribotypes (001, 014, 018, 012, 078, 126) from different regions of Italy (FIG. 8). The preparation of whole cell lysates was obtained by a method based on the freeze-thaw procedure described by Fagan and Fairweather (Fagan, R., and Fairweather, N. *J Biol Chem.* 286(31):27483-93, 2011). Briefly, cultures of *C. difficile* were harvested by centrifugation at 5,000×g for 10 min at 4° C. and the pellets frozen at −20° C. Bacteria were thawed, resuspended in PBS to an $OD_{600\ nm}$ of 20 and incubated at 37° C. for 10 min. Three such freeze-thaw cycles were carried out in order to obtain consistent and reproducible lysis. The extraction of S-layer was performed following a previously described method (Fagan, R., and Fairweather, N. *Methods Mol Biol* 646, 117-134, 2010).

Cell wall proteins were prepared from cultures grown in BHI broth to stationary phase ($OD_{600\ nm} \approx 1$). Extracts were separated by SDS-PAGE, followed by Western blotting with specific antibodies raised in mice. Primary antibodies were used at the dilution 1:2,000 and detected by using horseradish peroxidase-conjugated rabbit anti-mouse antibody at 1:20,000 (Dako) and the SuperSignal West Pico chemiluminescent substrate (Thermo Scientific Pierce). A marker for direct visualization of standard bands (MagicMark XP Western Protein Standard, Invitrogen) was used routinely for protein molecular weight estimation directly on Western blots. Expression of Dif 192 and Dif44 was detected in total extracts of all the clinical isolates analysed and indicating that these polypeptides are conserved and these polypeptides therefore also represent useful vaccine targets, particularly for the prevention of infection, reducing colonization or spread of infection.

Example 10: Recognition of Recombinant Polypeptides by Mouse Antibodies

To identify further surface and secreted proteins that are important in clostridial pathogenesis and able to elicit an antibody response in vivo, the inventors performed further analysis of culture supernatants, again prepared from the 630 clinical strain. There was no detectable cell lysis (data not shown).

Immunization of Mice with Concentrated Supernatant: To obtain the "anti-supernatant" serum, *C. difficile* 630 was grown in medium CDMM (Karasawa et al, 1995) performing two serial dilutions. A final culture with $OD_{600}$ 0.5 was obtained. The medium was separated from the bacteria by centrifugation followed by filtration through 0.22 μm filters, and the proteins contained in it were concentrated using Vivaspin centrifugal concentrators MWCO 5000 Da (Sigma). The resulting protein concentration was estimated with the bicinchoninic acid assay (Pierce, Rockford, Ill., USA). Eight mice were immunized with 20 μg of proteins per dose and the resulting sera were pooled to be used in western analysis.

Western Blot Analysis:

50 ng amount of each recombinant protein was loaded on a NuPAGE Gel and western blot analysis was carried out as followed, using as a primary antibody serum of mice immunized with concentrated supernatant. The samples containing purified recombinant proteins were mixed with sample buffer containing reducing agent and heated for 10 min at 100° C. prior to loading. The samples were separated by SDS-PAGE using the NuPAGE Gel System (Invitrogen) and transferred onto nitrocellulose membranes for Western blot analysis. The membranes were blocked 3 hours with PBS-10% milk powder at 4° C. Primary antibodies used are polyclonal mouse antisera raised against recombinant his-tagged proteins. All the primary antibodies were diluted 1:1000 and incubated 1 h and 30 min at 37° C.; the secondary antibody was goat anti-mouse serum conjugated to horseradish peroxidase (1:5000; Dako) and was incubated at room temperature for 45 min. Detection of bound antibodies was carried out with Super Signal Chemiluminescent Substrate (Pierce) following the manufacturer's instructions.

To prove that the selected surface-exposed polypeptides were able to elicit an antibody response in vivo, the presence of specific antibodies in the sera from mice was analyzed. Purified polypeptides were analyzed by Western blotting using sera from mice immunized with concentrated supernatants. Mice sera immunized with supernatant of *C. difficile* bacteria contains antibodies against able to recognize *C. difficile* recombinant polypeptides and fragments. Purified polypeptides and fragments of Dif183 were clearly detected by antibodies confirming the accessibility of these proteins during the infection and their suitability as vaccine targets (FIG. 14).

Example 11: Recognition of Recombinant Polypeptides by Hamster Antibodies 100 ng of each recombinant protein were subjected to SDS-PAGE and western blotting. Membranes were incubated with hamster sera at 1/200 dilution, followed by anti-mouse-HRP at 1/10,000 dilution. Sera were taken at: a) 15 days after the challenge from vaccinated hamsters; b) 30-50 hours after the challenge from unvaccinated hamsters. Serum from uninfected hamster was used as negative control. To prove that the selected surface-exposed polypeptides were able to elicit an antibody response in vivo, the presence of specific antibodies in the sera from infected hamsters was analyzed. Purified polypeptides were analyzed by Western blotting using sera from infected hamsters and from infected hamsters following the vaccination with A and B toxin combination.

Sera from infected hamsters were found to contain few antibodies against *C. difficile* polypeptides. This is primarily because infected hamsters die 30-50 hours after the infection—insufficient time to build an immune response against the bacterium. Therefore, polypeptides for which antibodies are present in these sera appear to be particularly useful for use in vaccine compositions and in the preparation of neutralizing antibodies.

Sera from hamsters that were vaccinated and subsequently infected contained antibodies able to recognize purified polypeptides. Immunization with a toxin combination (p5/6+toxB_GT) prior to infection enabled hamsters to generate an efficient antibody response preventing death but did not prevent colonization of *C. difficile*. Purified polypeptides and fragments were detected by antibodies present in the hamster sera from vaccinated and infected hamsters, confirming the surface accessibility of these proteins during the infection and their suitability as vaccine targets. Serum from uninfected hamster was used as negative control. For example, sera from hamsters vaccinated and subsequently infected contained antibodies able to recognize Dif44, Dif51, Dif130, Dif153, Dif183, Dif208, and Dif232 in the hamster sera from vaccinated and infected hamsters, confirming the surface accessibility of these proteins during the infection and their suitability as vaccine targets (FIG. 10).

Serum from uninfected hamster was used as negative control (FIG. 10B). Some bands were seen due to cross-reactions to *E. coli* contaminants present in the recombinant proteins preparations.

Example 12: Recognition by Antibodies from Human Sera (IgA and IgG)

In order to test recognition of recombinant polypeptides by human antibodies, the Inventors prepared and utilised a protein chip array.

1. Protein microarray procedures: The *C. difficile* protein array was generated by spotting purified recombinant proteins (0.5 mg/ml) in 4 replicates on nitrocellulose-coated slides (FAST slides, Schleicher and Schuell) using the inkjet spotter Arrayjet (Arrayjet Limited), fitted with a piezoelectric inkjet print head carrying more than 100 nozzles, resulting in spots of approximately 90-100 µm in diameter. As experimental controls, 4 curve replicates of biotinylated BSA, mouse IgG(s), human IgG(s) and human IgM(s) (from 0.004 to 0.5 mg/ml) were spotted on the arrays. PBS buffer was spotted in at least twice the number of the protein spots, and used to detect non-specific signals due to cross contamination during spotting. Fewer than 5% of the PBS spots showed signal intensity higher than the background value +3 Standard Deviation values.

Non-specific binding was minimised by pre-incubating arrays with a blocking solution containing 3% Top Block (Fluka-BioChemiKa)-0.1% Tween 20 in PBS buffer (TPBS). After washing with TPBS, human sera were diluted in 3% Top Block-TPBS and overlaid on the arrays at 25° C. for 1 h. After washing with TPBS, binding of antibodies to antigens printed on the arrays was detected by incubating the arrays with anti-human-Cy5 conjugated secondary antibodies (1:800) at 25° C. for 1 h. All incubation steps were conducted under agitation using the HS 4800 hybridization station (TECAN). Image fluorescence signals were detected with a PowerScannner3.5 scanner (TECAN) and the 16-bit images were generated with ScanArray™ software at 10 m per pixel resolution and spot Fluorescence Intensities (FI) were determined using ImaGene 6.0 software (Biodiscovery Inc, CA, USA). Elaboration and analysis was performed using in house-developed software. For each protein, the mean fluorescence intensity (MFI) of replicated spots was determined, after subtraction of the background value surrounding each spot. Signals were considered as positive when their MFI value was higher than 2,000 for the experiments with IgG and 1000 for the experiments with IgA, corresponding to the mean fluorescence intensity (MFI) of protein spots after detection with anti-human-Cy5 antibodies alone, plus 3 standard deviation values. Two controls where added: NN-His corresponding to MFI values of spots with cell extract of *E. coli* carrying an empty expression vector and PBS_Gly corresponding to MFI values of spots containing only buffer (background values). These values are automatically subtracted by the software from the value of each sample spot.

2. Western Blot analysis: Two hundred ng (200 ng) of each purified recombinant protein were loaded onto 1-mm 12-wells 4-12% Novex Bis-Tris NuPAGE pre-cast gels (Invitrogen), separated at 200 V for 35 min and transferred onto nitrocellulose membranes using the dry system iBlot (Invitrogen). The membranes were saturated with 10% Skim Milk (Difco) in PBS-T (PBS containing 0.05% Tween-20) and incubated for 1 h at RT with gentle agitation. The blocked membranes were then incubated with the human serum 4705WH diluted 1:500 in 1% Skim Milk PBS-T and incubated 3 h at RT. The membranes were washed with PBS-T once for 15 min and twice for 5 min.

The secondary anti-human IgG antibodies, HRP-conjugated SIGMA A-6029 (1:2,500 in 1% Skim Milk PBS-T) or anti-human IgA, Alkaline phosphatase-conjugated SIGMA A-9669 (1:3000 in 1% Skim Milk PBS-T) were then added and incubated for 40 min with gentle agitation. After one wash of 15 min and 3 washes of 5 min with PBS-T, the membranes were overlaid with the substrate SuperSignal WestPico (Pierce) solution and incubated for 5 min at RT with gentle agitation. The substrate in excess was removed with a paper towel and the membrane exposed to a radiographic film.

Human sera from convalescent donors (donor A, donor B, donor C, donor D, and donor E) and healthy donors (10WH, 3453WH, 4016BL, 4697WH and 4705WH) were obtained. The ELISA titers of the different sera are shown in FIG. 11. FGF21 is an unrelated protein which is a negative control and ToxA/B is a combination of Toxins A and B from Inverness Medical Inc. The sera from the convalescent donors, donor A, donor C and donor D have IgG against ToxA and Tox B compared to the IgG titer for FGF21 indicating that have mounted an immune response against *C. difficile*. Furthermore, the sera from the healthy donors 10WH and 4705WH have high IgG titers against ToxA and Tox B compared to the IgG titer for FGF21 indicating that they have been infected in the past and have previously mounted an immune response against *C. difficile* (FIG. 11).

Figure 12A:
Figure 12B:
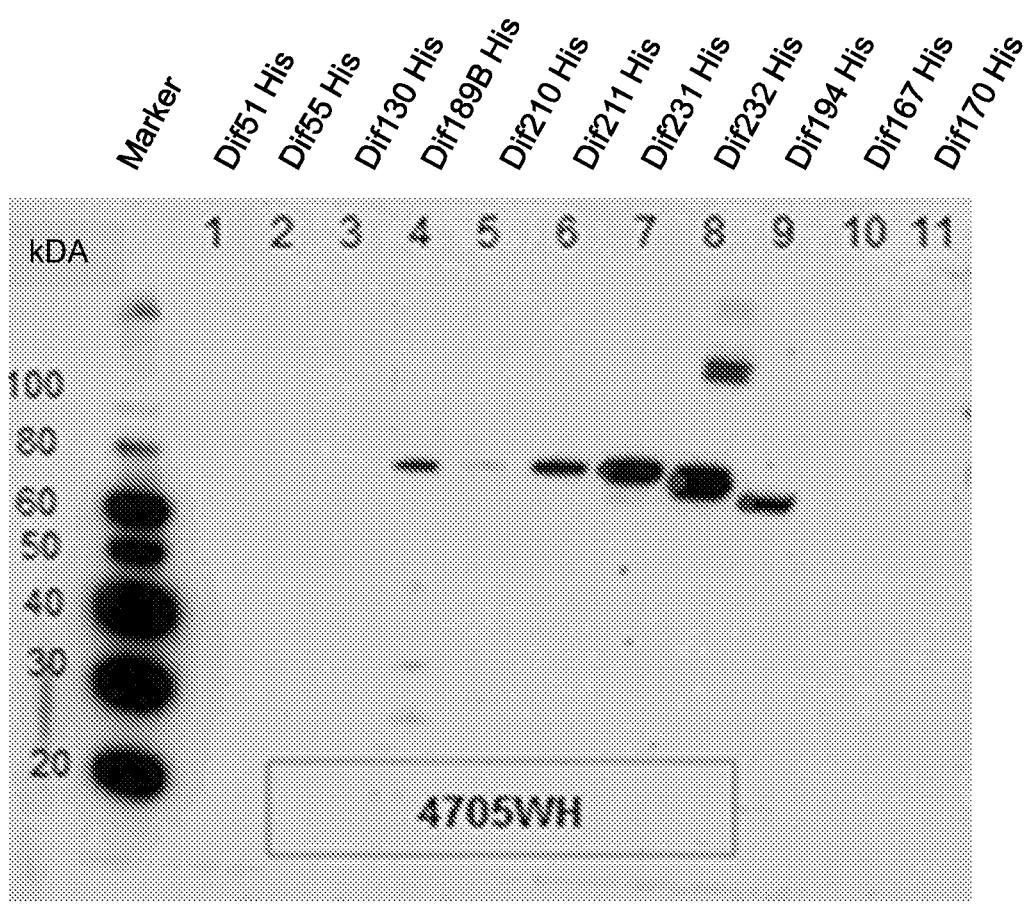

The presence of specific IgG in the sera is associated to an IgG systemic immune response against *C. difficile*. Using the protein array, the presence of specific IgG against the polypeptides in the human sera was identified. For example, using the protein array, the Inventors identified the presence of specific IgG against the Dif51, Dif130, Dif232 polypeptides in the human sera mentioned above. High titers of IgG (MFI>5000) against Dif232 polypeptide have been measured in the serum named 4705WH (FIG. 12A). The presence in the serum named 4705WH of IgG against Dif232 was confirmed by Western Blot (FIG. 12B).

The polypeptides which show a strong reaction may be particularly useful in an immunogenic or vaccine composition particularly for use in humans. Furthermore the detection of specific IgA in the sera is associated to a mucosal immune response against *C. difficile*. The presence of specific IgA against the polypeptides of the invention in the human sera was determined. For example, the Inventors identified the presence of specific IgA against the Dif51, polypeptide in the human sera (summarized below and in FIG. 13A).

Figure 13B:
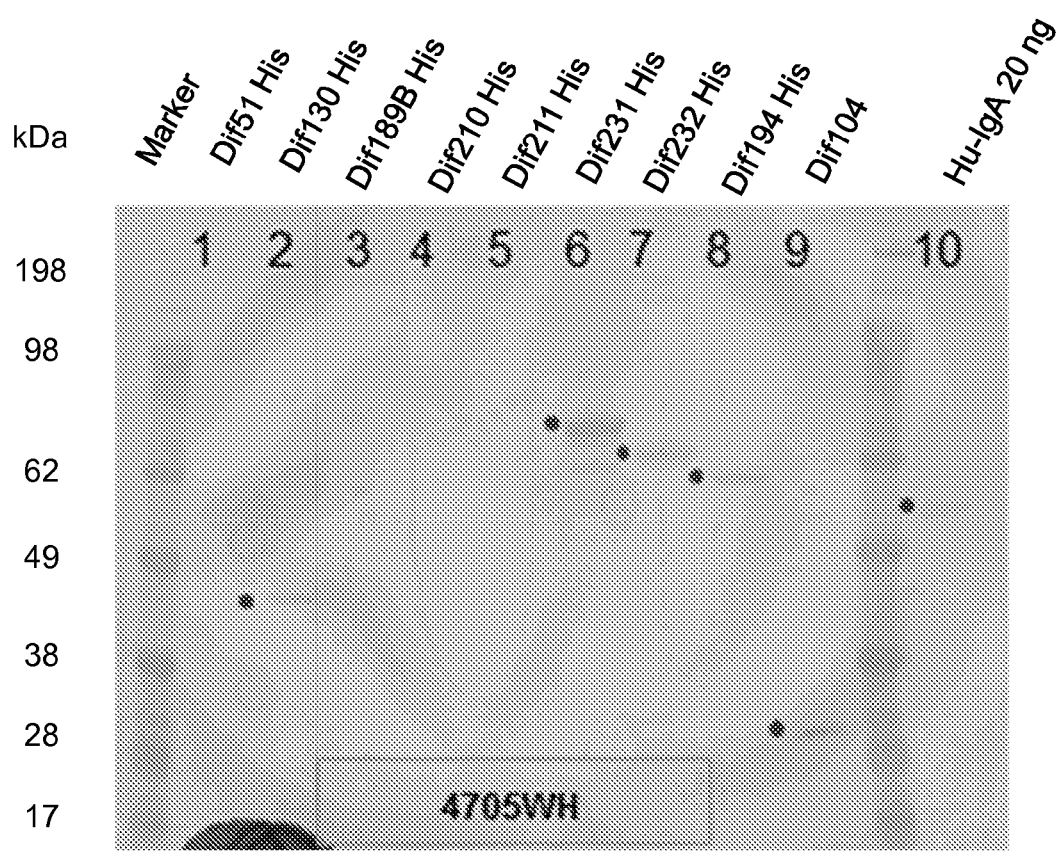

A titer of IgA (MFI>1000) against Dif51 polypeptide was measured in the serum named donor C. A titer of IgA (MFI>1000) against Dif130 polypeptides was measured in the sera named donor A, donor C, donor D, 3453WH and 4705WH. The polypeptides which show a strong reaction may be particularly useful in an immunogenic or vaccine composition for generating a mucosal immune response providing protection directed to an organism's various mucous membranes. This is particularly the case for *C. difficile* where infection may be limited to the colonic mucosa. The presence of IgA against Dif130 and Dif232 polypeptide in the serum 4705WH was confirmed by Western Blot (FIG. 13B). These polypeptides may be particularly useful in an immunogenic or vaccine composition for generating a mucosal immune response providing protection directed to an organism's various mucous membranes. This is particularly the case for *C. difficile* where infection may be limited to the colonic mucosa. Table 2 summarizes the polypeptides that were recognised by human sera (4705 WH) in protein chip and western blot analysis.

| Name | Annotation | Predicted Location |
|---|---|---|
| Dif130 | Bacterial extracellular solute-binding protein | Lipoprotein |
| Dif232 | Putative cell wall anchored protein | LPXTG-like motif |

Example 13: Further Analysis of Dif153 (CD2830)

Dif153 has been detected in the surnatant of 630 and Stoke_Mandeville strain. Dif153 is annotated as a hypothetical protein of 220 aminoacids. BLAST analysis showed homology to Anthrax Lethal Factor proteins (LF), a family of zinc metallopeptidases. In particular, Dif153 shows homology to the C-terminal domain (residues 589-810) of the Anthrax lethal factor. The N-terminal domain of Anthrax, necessary for interaction with the Protective Antigen, is missing. The catalytic site (HEXXH) is conserved in Dif153 suggesting the the *C. difficile* protein might be a zinc-dependent metalloprotease (FIG. 15). To understand if this protein is able to bind Zinc or other divalent cations, NMR analysis was performed using a recombinant protein. This analysis revealed the ability of the recombinant protein to bind zinc, nickel and copper but not calcium.

To investigate if Dif153 has a proteolytic activity, a fluorimetric analysis was carried out to test the ability of the recombinant protein to cleave a gelatin substrate (FIG. 18). This analysis showed that the recombinant protein has a weak gelatinase/collagenase activity in the presence of zinc, but not in the presence of nickel and copper or in the apo form. It has been reported that Clostridia secrete several metallopeptidases that are responsible for the digestion of extracellular matrix components. Therefore, the inventors tested in vitro the proteolytic activity of the recombinant protein on several extracellular matrix elements (collagen I-VI and fibronectin). A preliminary analysis showed that the recombinant protein is able to cut fibronectin (FIG. 16).

Further characterisation of Dif153 was performed as follows: The proteolytic activity on other extracellular matrix elements is assessed, and the cleavage site is identified by mass spec sequencing of fibronectin fragments. In vitro assays are performed to understand if the protein has a toxic effect on human cells. In vitro assays are performed to understand if the protein has an effect on the organization of the fibronectin matrix of human cells. Confirmation that the observed enzymatic activity is specific for Dif153 is achieved by generating an inactive recombinant protein mutated in the catalytic site. This polypeptide which is a new zinc-metellopeptidase with fibronectin-degradating activity may be a good candidate for limiting or preventing the colonization of *C. difficile*.

Example 14: Further Analysis of Dif183

To characterize the function of Dif183 (CD3669), a deletion mutant was generated. The subcellular localization of Dif183 was investigated by confocal microscopy on vegetative cells and by western blot analysis on cellular fractions. The method is described in Example 6. These analyses showed that Dif183 is associated to the bacterial surface (FIG. 19).

The presence of Dif183 in culture supernatants (collected both in exponential phase and after 48 hours of stationary phase) was confirmed by Western blotting. Moreover, immunoblotting analysis revealed that it is not only on the total supernatant, but also in ultracentrifugation fractions. After 48 hours of stationary phase the inventors detected the protein both in the ultracentrifugation supernatant and in the ultracentrifugation pellet. This observation could indicate an association of the protein with macromolecular structures (flagella, vesicles) that were previously observed in supernatants pellets by electron microscopy (FIG. 20).

To investigate the function of Dif183, growth curve of the deletion mutant in rich medium was compared to the wild type. Vital counts of both vegetative cells and spores were performed (FIG. 21). While in exponential phase the mutant has a growth profile comparable to the wt (FIG. 21A), optical density of the mutant strain decreases faster during the late stationary phase (FIG. 21B). Vital counts of vegetative cells did not show a difference between wt and mutant (FIG. 21C). On the contrary, vital counts of mutant spores after ETOH inactivation of vegetative cells were about 10 fold less than the wt (FIG. 21D). This phenotype can be associated to a defect in one or more biological processes, such as formation of the spore, resistance of spores to ethanol treatment or germination of spores.

Further characterisation of Dif183 is performed. A Dif183 complemented strain is generated to confirm the specificity of the phenotype observed. Protein expression is tested at different timepoints of growth and in spore extracts. It is determined whether the phenotype is associated with a sporulation or germination defect (spore count, germination assays). The effect of wild type and knock out supernatants are tested on spore germination. Electron microscopy analysis is performed on knock out and wild type on vegetative cells and spores. This polypeptide which is a new sporulation/germination factor may be a good candidate for limiting or preventing the colonization of *C. difficile*.

From over 3700 potential targets, the Inventors have used a combination of techniques to identify various polypeptides with potentially significant utility in *C. difficile* infection. The SEQ ID NOs and DIF identifier for each of these polypeptides is shown in FIG. 1 and the predicted localization of these polypeptides is summarized in FIG. 2.

Example 15: Combination of toxB_GT and TcdA Fragments with Polypeptide Antigens

Hamster immunisation studies typically involved Golden Syrian hamsters. Antigens were tested by systemic immunisations (on 4 occasions separated by two weeks). Differences in time to death, signs of infection and colonisation of bacteria were tested.

Female Golden Syrian hamsters (100 g weight) were purchased from Harlan Olac, UK. The animals were housed individually and given water and food ad libitum. Telemetry chips (Vitalview Emitter) were inserted i.p. by laparotomy at least 3 weeks before the first vaccination. Once the wounds healed, the animals were placed on receiver pads, and the body temperature and activity were monitored (Vital View software). Animals were immunized via intra peritoneal (i.p.) with four doses of antigen combinations (50 ugr of p5-6 and toxB_GT with either 20 µg of the anti-colonisation antigens Dif044 or DIF208) formulated in MF59 adjuvant at days 1, 14, 28 and 36. All components were stored correctly and were subject to minimal freeze/thaw cycles.

To ensure the sensitivity of each animal to colonization, on day 60 each were treated with 30 mg/kg of clindamycin phosphate. After 12 hours following administration of the antibiotic, each hamster was challenged with approximately 1000 spores of *C. difficile* 630.

Following challenge, animals were closely monitored for signs of infection including onset and duration of loose stools (wet tail). As previously reported, animals showing drop of body temperature of more than two degree (35° C.) were culled. Animals whose temperature failed to drop below 35° C. but that lost more than 10% of their body mass were also culled. Animals surviving for more than two weeks post challenge were considered to have recovered from the infection and were culled to provide an endpoint to the experiment.

1. Times to death: the time taken to reach 35° C. post challenge of the animals.

| | Strain | Time at cull | Clinical signs |
|---|---|---|---|
| H1 | P5/6 + toxB_GT + DIF044 | 14 days | None |
| H2 | P5/6 + toxB_GT + DIF044 | 14 days | None |
| H3 | P5/6 + toxB_GT + DIF044 | 14 days | None |
| H4 | P5/6 + toxB_GT + DIF044 | 14 days | None |
| H5 | P5/6 + toxB_GT + DIF044 | 14 days | None |
| H6 | P5/6 + toxB_GT + DIF208 | 14 days | None |
| H7 | P5/6 + toxB_GT + DIF208 | 14 days | None |
| H8 | P5/6 + toxB_GT + DIF208 | 14 days | None |
| H9 | P5/6 + toxB_GT + DIF208 | 14 days | None |
| H10 | P5/6 + toxB_GT + DIF208 | 14 days | None |

All animals survived challenge with $9.4 \times 10^4$ spores/dose and none of the animals showed any clinical signs including diarrhoea. Faecal pellets were collected throughout to check for shedding of spores. This is in line with observations made (eg in WO2013/084071) for immunisation with P5/6+ toxB_GT without the anti-colonisation antigens.

2. Body temperatures: All animals' temperatures were monitored by telemetry throughout the experiment. All animals showed normal diurnal temperature fluctuations, with no impact being observed in the first 48 h for animals 6-9. The telemetry chip in H10 was not working therefore no temperature data is available for this animal. Representative results are shown in FIG. 23.

3. Shedding of *C. difficile* spores in faeces of vaccinated animals: Faecal pellets were collected on various days after challenge. These were collected by either placing the animal into a new sterile cage or following replacement of soiled bedding with clean sterile bedding. Pellets were resuspended in sterile PBS and the number of *C. difficile* organisms recovered were enumerated by plating onto Braziers CCEY agar with erythromycin. The number of colonies per 100 mg faecal material was then determined. Results show that the initial shedding of *C. difficile* in animals vaccinated with the anti-colonisation factor antigens (DIF044 and DIF208) are similar to the levels shed in vaccinated with the toxin fragments alone (historical data from animals immunised with p5/6+tox GT). The levels of shedding in the anti-colonisation factor vaccinated animals drop between days 3 and 4 after challenge at a time when typically we have observed the levels of bacteria to increase in toxin fragment only immunised animals. By day 8 after challenge the levels of shedding in all groups of vaccinated animals are similar (FIG. 24).

4. *C. difficile* colonisation in the gut at endpoint: Numbers of *C. difficile* were enumerated localised in the lumen of the caecum (Cae-LA) and colon (Col-LA) and those associated with the tissue of these organs (Cae-TA and Col-TA). Guts were removed and bacterial counts on recovered bacteria determined. To enumerate the total bacterial load (spores and vegetative cells), each section was opened longitudinally, and the contents were removed by gentle washing in two changes of 10 ml PBS. Tissues were homogenized in 5 ml of PBS for 1 min using a Stomacher, and viable counts were determined for the homogenates. Serial 10-fold dilutions were plated on CCFA blood agar plates containing 20 g/ml amphotericin B to suppress yeast growth. To estimate the numbers of spores present in the samples, the samples were heated for 10 min at 56° C., and the numbers of spores present were determined by the viable count method. Microbiological analysis showed that H1, H4, H5 and H6 had no detectable *C. difficile* at the experimental endpoint. H8 and H10 had very low numbers of *C. difficile* with only a few colonies growing at the endpoint (FIG. 25). The average colonisation of the gut at endpoint was compared with results from the previous experiment with animals that were vaccinated with p5/6+toxB_GT alone (FIG. 26).

The number of *C. difficile* isolated was highest in all groups in the lumen of the colon. The numbers of bacteria associated with the lumen of both the caecum and colon were comparable in all vaccinated groups. The number of bacteria in groups vaccinated with the anti-colonisation antigens were lower associated with the tissue in the caecum. No bacteria were isolated from the group vaccinated with DIF044 associated with the tissue in the colon.

5. Toxin estimation in gut contents: Assessments of toxin content in the gut were also performed. Gut washes were filtered through a 0.22 µm filter to remove bacterial cells. Filtered washes were then placed on confluent Vero cells at 10-fold decreasing concentrations (5-fold for the colon) for 24 hours. After incubation, cells were washed, fixed, and then coloured with Giemsa stain. If toxin was present then cell rounding caused detachment and the absence of colour. Toxin-content data represents the dilutions at which the cells remained attached (stained). There was very little no active toxin present in any of the gut samples estimated by the addition of gut content samples onto either HT29 cells (susceptible to toxin A) or Vero cells (susceptible to toxin B) as shown in FIG. 27.

6. Antibody detection and gut washes sera: Sera or gut washes from hamsters were test for the measurement of anti toxin, anti Dif44 and anti Dif208 antibodies, by Western Blot. For this analysis 200 ng of each recombinant protein (p5-6, toxB_GT, Dif44 and Dif208) were separated by SDS-PAGE using the NuPAGE Gel System (Invitrogen) and transferred onto nitrocellulose membranes for Western blot analysis. The membranes were blocked 1 hour with PBS-10% milk powder at room temperature. The membranes were then incubated with either serum (dil 1:200) or gut washes (dil 1:10) from hamsters of Example 15 for 90 min at 37° C.: Particularly, sera or gut washes from hamsters 1-5 of Example 15 were employed to detect antiDi44 antibodies and sera or gut washes from hamsters 6-10 of Example 15 were employed to detect anti Dif44 antibodies. After incubation with anti-hamster secondary antibody (dil. 1:10,000) for 45 min at 37° C., the detection of bound antibodies was carried out with Super Signal Chemiluminescent Substrate (Pierce) following the manufacturer's instructions.

It can be seen from FIGS. 28 and 29 that anti Dif44 and anti Dif208 antibodies are present in serum and gut washes.

Example 16: Anti Dif44 Antibodies Recognise Other CWP Proteins

To determine if anti Dif44 antibodies could cross react with other cwp proteins, 200 ng of various samples were loaded onto a gel and subjected to Western Blot. Each recombinant cwp protein (listed in FIG. 30) were separated by SDS-PAGE using the NuPAGE Gel System (Invitrogen) and transferred onto nitrocellulose membranes for Western blot analysis.

| Gel 1 | | | Gel 2 | | |
|---|---|---|---|---|---|
| Lane | Protein | Internal name | Lane | Protein | Internal name |
| 1 | M | | 1 | M | |
| 2 | S-Layer extract | | 2 | cwp14 | dif139 |
| 3 | LMW 630 cwp1 | dif205A | 3 | cwp15 (V) | dif189A |
| 4 | LMW SM cwp1 | dif327A | 4 | cwp15 (V) | dif189B |
| 5 | HMW 630 | | 5 | cwp16 | dif192 |
| 6 | HMW SM | | 6 | cwp18 | dif53 |
| 7 | cwp3 | dif204 | 7 | cwp20 | dif75A |
| 8 | cwp5 | dif146 | 8 | cwp21 | dif211 |
| 9 | cwp6 | dif145 | 9 | cwp25 | dif44 |
| 10 | cwp7 | dif144 | 10 | cwp26 | dif195 |
| 11 | cwp10 | dif207 | 11 | cwp27 | dif187 |
| 12 | cwp11 | dif149 | 12 | cwp29 | dif201 |

The membranes were blocked 1 hour with PBS-10% milk powder at room temperature. The membranes were then incubated with serum from hamsters 1-5 of Example 15 (dil 1:200) for 90 min at 37° C. After incubation with anti-hamster secondary antibody (dil. 1:10,000) for 45 min at 37° C., the detection of bound antibodies was carried out with Super Signal Chemiluminescent Substrate (Pierce) following the manufacturer's instructions.

As shown in FIG. 30, serum antibodies recognised cwp1, cwp3, cwp6, cwp7, cwp11, cwp14, cwp20, cwp21, cwp25, cwp26, cwp27 and cwp29. The same samples were also incubated with the serum from hamsters vaccinated with p5_6+ToxB-GT. Possible antibodies against cwp proteins present in this serum are due to immune response against the bacteria challenged after vaccination. A weak reactivity is detected only against cwp5, cwp25, cwp26, cwp29, demonstrating that the addition of dif44 in the vaccination confers an advantage in the response against *C. difficile*.

Example 17: Combination of ToxB-GT and P5_6 Fragments with DIF44 and DIF208 Polypeptide Antigens Immunogenic compositions are prepared as described above. Three compositions are administered as follows: 8 hamsters with ToxB_GT+P5_6+DIF208+DIF44, 4 hamsters with ToxB_GT+P5_6 (negative control), using the standard administration procedures described elsewhere. 6 of the 8 hamsters administered with ToxB_GT+P5_6+DIF208+DIF44 were challenged with *C. difficile*, while 2 were left unchallenged. Differences in time to death, and colonisation of bacteria were tested in vivo. Because it has not previously been possible to determine whether antibodies to DIF 44 which were observed e.g. in the serum of immunized and challenged hamsters result from infection or the vaccination, western blots to observe the antibodies present in the serum and gut washed from the vaccinated but unchallenged hamsters are also carried out.

| Description | SEQ ID: |
|---|---|
| Full length TcdA | 1 |
| Full length TcdB | 2 |
| ToxA-ED | 3 |
| ToxA-GT | 4 |
| ToxA-CP | 5 |
| ToxA-T | 6 |
| ToxA-T4 | 7 |
| ToxA-B | 8 |
| ToxA-PTA2 | 9 |
| ToxA-P5-7 | 10 |
| ToxA-P5-6 | 11 |
| ToxA-P9-10 | 12 |
| ToxA-B2 | 13 |
| ToxA-B3 | 14 |
| ToxA-B5 | 15 |
| ToxA-B6 | 16 |
| ToxB-ED | 17 |
| ToxB-GT | 18 |
| ToxB-CP | 19 |
| ToxB-T | 20 |
| ToxB-B | 21 |
| ToxB-B2 | 22 |
| ToxB-B7 | 23 |
| B4 hybrid | 24 |
| Linker | 25 |
| Linker | 26 |
| Linker | 27 |
| IC-31 | 28 |
| Polycationic polymer | 29 |
| Full length TcdA | 30 |
| Full length TcdB | 31 |
| ToxA-ED | 32 |
| ToxA-GT | 33 |
| ToxA-CP | 34 |
| ToxA-T | 35 |
| ToxA-T4 | 36 |
| ToxA-B | 37 |
| ToxA-PTA2 | 38 |
| ToxA-P5-7 | 39 |
| ToxA-P5-6 | 40 |
| ToxA-P9-10 | 41 |
| ToxA-B2 | 42 |
| ToxA-B3 | 43 |
| ToxA-B5 | 44 |
| ToxA-B6 | 45 |
| ToxB-ED | 46 |
| ToxB-GT | 47 |
| ToxB-CP | 48 |
| ToxB-T | 49 |
| ToxB-B | 50 |
| ToxB-B2 | 51 |
| ToxB-B7 | 52 |
| B4 hybrid | 53 |
| ToxA-ED (peptide) | 54 |
| ToxA-ED (encoding nucleic acid) | 55 |
| ToxA-GT (peptide) | 56 |
| ToxA-GT (encoding nucleic acid) | 57 |
| ToxB-ED (peptide) | 58 |
| ToxB-ED (encoding nucleic acid) | 59 |
| ToxB-GT (peptide) | 60 |
| ToxB-GT (encoding nucleic acid) | 61 |
| ToxA-CP (peptide) | 62 |
| ToxA-CP (encoding nucleic acid) | 63 |
| ToxB-CP (peptide) | 64 |

-continued

| Description | SEQ ID: |
|---|---|
| ToxB-CP (encoding nucleic acid) | 65 |
| ToxA-PTA2 (encoding nucleic acid) | 66 |
| ToxA-P9-10 (encoding nucleic acid) | 67 |
| ToxB-B (encoding nucleic acid) | 68 |
| ToxB-B2 (encoding nucleic acid) | 69 |
| Dif14_CD0237 | 70 |
| Dif14_CD0237 | 71 |
| Dif15_CD0239 | 72 |
| Dif15_CD0239 | 73 |
| Dif16_CD0300 | 74 |
| Dif16_CD0300 | 75 |
| Dif40_CD0755 | 76 |
| Dif40_CD0755 | 77 |
| Dif44_CD0844 | 78 |
| Dif44_CD0844 | 79 |
| Dif51_CD0999 | 80 |
| Dif51_CD0999 | 81 |
| Dif55_CD1135 | 82 |
| Dif55_CD1135 | 83 |
| Dif104_CD2177 | 84 |
| Dif104_CD2177 | 85 |
| Dif109A_f1-539_CD2247 | 86 |
| Dif109A_f1-539_CD2247 | 87 |
| Dif109B_f541-1132_CD2247 | 88 |
| Dif109B_f541-1132_CD2247 | 89 |
| Dif114_CD2365 | 90 |
| Dif114_CD2365 | 91 |
| Dif130_CD2645 | 92 |
| Dif130_CD2645 | 93 |
| Dif144_CD2782 | 94 |
| Dif144_CD2782 | 95 |
| Dif171A_f22-568_CD3392 | 96 |
| Dif171A_f22-568_CD3392 | 97 |
| Dif171B_f561-976_CD3392 | 98 |
| Dif171B_f561-976_CD3392 | 99 |
| Dif189A_f28-498_CD0514 | 100 |
| Dif189A_f28-498_CD0514 | 101 |
| Dif189B_f521-1622_CD0514 | 102 |
| Dif189B_f521-1622_CD0514 | 103 |
| Dif192_CD1035 | 104 |
| Dif192_CD1035 | 105 |
| Dif194_CD1131 | 106 |
| Dif194_CD1131 | 107 |
| Dif201_CD2518 | 108 |
| Dif201_CD2518 | 109 |
| Dif208A_f32-480_CD2831 | 110 |
| Dif208A_f32-480_CD2831 | 111 |
| Dif208B_f481-938_CD2831 | 112 |
| Dif208B_f481-938_CD2831 | 113 |
| Dif210_CD3145 | 114 |
| Dif210_CD3145 | 115 |
| Dif211_CD3192 | 116 |
| Dif211_CD3192 | 117 |
| Dif212_CD3246 | 118 |
| Dif212_CD3246 | 119 |
| Dif225_CD0438 | 120 |
| Dif225_CD0438 | 121 |
| Dif231_CD1021 | 122 |
| Dif231_CD1021 | 123 |
| Dif232_CD1031 | 124 |
| Dif232_CD1031 | 125 |
| Dif109_CD2247 | 126 |
| Dif109_CD2247 | 127 |
| Dif171_CD3392 | 128 |
| Dif171_CD3392 | 129 |
| Dif189_CD0514 | 130 |
| Dif189_CD0514 | 131 |
| Dif208_CD2831 | 132 |
| Dif208_CD2831 | 133 |

-continued

| Description | SEQ ID: |
|---|---|
| Dif16_CD0300 | 134 |
| Dif16_CD0300 | 135 |
| Dif40_CD0755 | 136 |
| Dif40_CD0755 | 137 |
| Dif44_CD0844 | 138 |
| Dif44_CD0844 | 139 |
| Dif51_CD0999 | 140 |
| Dif51_CD0999 | 141 |
| Dif55_CD1135 | 142 |
| Dif55_CD1135 | 143 |
| Dif104_CD2177 | 144 |
| Dif104_CD2177 | 145 |
| Dif109A_f1-539_CD2247 | 146 |
| Dif109A_f1-539_CD2247 | 147 |
| Dif109B_f541-1132_CD2247 | 148 |
| Dif109B_f541-1132_CD2247 | 149 |
| Dif114_CD2365 | 150 |
| Dif114_CD2365 | 151 |
| Dif130_CD2645 | 152 |
| Dif130_CD2645 | 153 |
| Dif144_CD2782 | 154 |
| Dif144_CD2782 | 155 |
| Dif171A_f22-568_CD3392 | 156 |
| Dif171A_f22-568_CD3392 | 157 |
| Dif171B_f561-976_CD3392 | 158 |
| Dif171B_f561-976_CD3392 | 159 |
| Dif189A_f28-498_CD0514 | 160 |
| Dif189A_f28-498_CD0514 | 161 |
| Dif189B_f521-1622_CD0514 | 162 |
| Dif189B_f521-1622_CD0514 | 163 |
| Dif192_CD1035 | 164 |
| Dif192_CD1035 | 165 |
| Dif194_CD1131 | 166 |
| Dif194_CD1131 | 167 |
| Dif201_CD2518 | 168 |
| Dif201_CD2518 | 169 |
| Dif208A_f32-480_CD2831 | 170 |
| Dif208A_f32-480_CD2831 | 171 |
| Dif208B_f481-938_CD2831 | 172 |
| Dif208B_f481-938_CD2831 | 173 |
| Dif210_CD3145 | 174 |
| Dif210_CD3145 | 175 |
| Dif211_CD3192 | 176 |
| Dif211_CD3192 | 177 |
| Dif212_CD3246 | 178 |
| Dif212_CD3246 | 179 |
| Dif225_CD0438 | 180 |
| Dif225_CD0438 | 181 |
| Dif231_CD1021 | 182 |
| Dif231_CD1021 | 183 |
| Dif232_CD1031 | 184 |
| Dif232_CD1031 | 185 |
| Dif183_CD3669 | 186 |
| Dif183_CD3669 | 187 |
| Dif183_CD3669 | 188 |
| Dif183_CD3669 | 189 |
| Dif14A_f1-278_CD0237 | 190 |
| Dif14B_f279-507_CD0237 | 191 |
| Dif207_CD2796 | 192 |
| Dif207_CD2796 | 193 |

-continued

| Description | SEQ ID: |
|---|---|
| Dif207_CD2796 | 194 |
| Dif207_CD2796 | 195 |
| Dif207_CD2796, Reverse complement, Length 25 | 196 |
| Dif251_CD1858, primer Front, Length 22 | 197 |
| Dif251_CD1858, primer Reverse complement, Length 24 | 198 |
| Dif327A_CDR20291_2682, primer Front, Length 16 | 199 |
| Dif327A_CDR20291_2682, primer Reverse complement, Length 25 | 200 |
| dif14 (Forward Primer) | 201 |
| dif14 (Reverse Primer) | 202 |
| dif15 (Forward Primer) | 203 |
| dif15 (Reverse Primer) | 204 |
| dif16 (Forward Primer) | 205 |
| dif16 (Reverse Primer) | 206 |
| dif40 (Forward Primer) | 207 |
| dif40 (reverse Primer) | 208 |
| dif44 (Forward Primer) | 209 |
| dif44 (Reverse Primer) | 210 |
| dif55 (Forward Primer) | 211 |
| dif55 (Reverse Primer) | 212 |
| dif130 (Forward Primer) | 213 |
| dif130 (Reverse Primer) | 214 |
| dif144 (Forward Primer) | 215 |
| dif144 (ReversePrimer) | 216 |
| dif109f1-539 (Forward Primer) | 217 |
| dif109f1-539 (Reverse Primer) | 218 |
| dif109f541-1132 (Forward Primer) | 219 |
| dif109f541-1132 (Reverse Primer) | 220 |
| dif207 (Forward Primer) | 221 |
| dif207 (Reverse Primer) | 222 |
| dif208f32-480 (Forward Primer) | 223 |
| dif208f32-480 (Reverse Primer) | 224 |
| dif208f481-938 (Forward Primer) | 225 |
| dif208f481-938 (Reverse Primer) | 226 |
| dif210 (Forward Primer) | 227 |
| dif210 (Reverse Primer) | 228 |
| dif211 (Forward Primer) | 229 |
| dif211 (Reverse Primer) | 230 |
| dif212 (Forward Primer) | 231 |
| dif212 (Reverse Primer) | 232 |
| dif225 (Forward Primer) | 233 |
| dif225 (Reverse Primer) | 234 |
| dif231 (Forward Primer) | 235 |
| dif231 (Reverse Primer) | 236 |
| dif232 (Forward Primer) | 237 |
| dif232 (Reverse Primer) | 238 |
| dif171f22-568 (Forward Primer) | 239 |
| dif171f22-568 (Reverse Primer) | 240 |
| dif171f561-976 (Forward Primer) | 241 |
| dif171f561-976 (Reverse Primer) | 242 |
| dif189f28-498 (Forward Primer) | 243 |
| dif189f28-498 (Reverse Primer) | 244 |
| dif189f521-1622 (Forward Primer) | 245 |
| dif189f521-1622 (Reverse Primer) | 246 |
| dif192 (Forward Primer) | 247 |
| dif192 (Reverse Primer) | 248 |
| dif194 (Forward Primer) | 249 |
| dif194 (Reverse Primer) | 250 |

-continued

| Description | SEQ ID: |
|---|---|
| dif201 (Forward Primer) | 251 |
| dif201 (Reverse Primer) | 252 |
| dif51 (Forward Primer) | 253 |
| dif51 (Reverse Primer) | 254 |
| dif104 (Forward Primer) | 255 |
| dif104 (Reverse Primer) | 256 |
| dif114 (Forward Primer) | 257 |
| dif114 (Reverse Primer) | 258 |
| Dif145_CD2784 | 259 |
| Dif145_CD2784 | 260 |
| Dif149_CD2795 | 261 |
| Dif149_CD2795 | 262 |
| Dif204_CD2789 | 263 |
| Dif204_CD2789 | 264 |
| Dif205_CD2793 | 265 |
| Dif205_CD2793 | 266 |
| Dif145_CD2784 | 267 |
| Dif145_CD2784 | 268 |
| Dif149_CD2795 | 269 |
| Dif149_CD2795 | 270 |
| Dif204_CD2789 | 271 |
| Dif204_CD2789 | 272 |
| Dif205_CD2793 | 273 |
| Dif205_CD2793 | 274 |
| Dif145_CD2784_primer Front_Length 23 | 275 |
| Dif145_CD2784_primer Reverse complement_Length 26 | 276 |
| Dif149_CD2795_primer Front_Length 23 | 277 |
| Dif149_CD2795_primer reverse complement_Length 18 | 278 |
| Dif204_CD2789_primer front_Length 23 | 279 |
| Dif204_CD2789_primer reverse complement_Length 23 | 280 |
| Dif205_CD2793_primer front_Length 20 | 281 |
| Dif205_CD2793_primer reverse complement_Length 28 | 282 |
| Dif12_CD0183 | 283 |
| Dif12_CD0183 | 284 |
| Dif52_CD1029 | 285 |
| Dif52_CD1029 | 286 |
| Dif53_CD1047 | 287 |
| Dif53_CD1047 | 288 |
| Dif75_CD1469 | 289 |
| Dif75_CD1469 | 290 |
| Dif75A_f30-715_CD1469 | 291 |
| Dif75A_f30-715_CD1469 | 292 |
| Dif75B_f715-1007_CD1469 | 293 |
| Dif75B_f715-1007_CD1469 | 294 |
| Dif106_CD2193 | 295 |
| Dif106_CD2193 | 296 |
| Dif146_CD2786 | 297 |
| Dif146_CD2786 | 298 |
| Dif153_CD2830 | 299 |
| Dif153_CD2830 | 300 |
| Dif196_CD1751 | 301 |
| Dif196_CD1751 | 302 |
| Dif207_CD2796 | 303 |
| Dif207_CD2796 | 304 |
| Dif251_CD1858 | 305 |
| Dif251_CD1858 | 306 |
| Dif327_CDR20291_2682 | 307 |
| Dif327_CDR20291_2682 | 308 |
| SleC_CD0551 | 309 |
| SleC_CD0551 | 310 |
| Dif12_CD0183 | 311 |
| Dif12_CD0183 | 312 |
| Dif52_CD1029 | 313 |
| Dif52_CD1029 | 314 |
| Dif53_CD1047 | 315 |
| Dif53_CD1047 | 316 |
| Dif106_CD2193 | 317 |

| Description | SEQ ID: |
|---|---|
| Dif106_CD2193 | 318 |
| Dif146_CD2786 | 319 |
| Dif146_CD2786 | 320 |
| Dif153_CD2830 | 321 |
| Dif153_CD2830 | 322 |
| Dif196_CD1751 | 323 |
| Dif196_CD1751 | 324 |
| Dif207_CD2796 | 325 |
| Dif207_CD2796 | 326 |
| Dif251_CD1858 | 327 |
| Dif251_CD1858 | 328 |
| Dif327A_CDR20291_2682 | 329 |
| Dif327A_CDR20291_2682 | 330 |
| Dif12A_f25-170_CD0183 | 331 |
| Dif12_CD0183, primer Front, Length 22 | 332 |
| Dif12_CD0183, primer Reverse complement, Length 26 | 333 |
| Dif52_CD1029, Primer Front, Length 25 | 334 |
| Dif52_CD1029, Primer Reverse complement, Length 29 | 335 |
| Dif53_CD1047, Primer Front, Length 25 | 336 |
| Dif53_CD1047, Primer Front, Length 25 | 337 |
| Dif75A_f30-715_CD1469, primer Front, Length 25 | 338 |
| Dif75A_f30-715_CD1469, primer Reverse complement, Length 25 | 339 |
| Dif75B_f715-1007_CD1469, primer Front, Tm ~57°, Length 19 | 340 |
| Dif75B_f715-1007_CD1469, primer Reverse complement, Length 26 | 341 |
| Dif106_CD2193, primer Front, Length 25 | 342 |
| Dif106_CD2193, primer Reverse complement, Length 20 | 343 |
| Dif146_CD2786, primer Front, Length 22 | 344 |
| Dif146_CD2786, primer Reverse complement, Length 24 | 345 |
| Dif153_CD2830, primer Front, Length 28 | 346 |
| Dif153_CD2830, primer Reverse complement, Length 23 | 347 |
| Dif196_CD1751, primer Front, Length 24 | 348 |
| Dif196_CD1751_Reverse complement, Length 25 | 349 |
| Dif207_CD2796, primer Front, Length 20 | 350 |
| GSGGGG | 351 |
| GSGSGGGG | 352 |
| ASGGGS | 353 |
| ICICICICICICICICICICIC | 354 |
| KLKLLLLLKLK | 355 |
| Dif51 without N-terminal Cyst | 356 |
| Dif51 without N-terminal Cyst | 357 |
| Dif130 without N-terminal Cyst | 358 |
| Dif130 without N-terminal Cyst | 359 |
| Dif183 without N-terminal Cyst | 360 |
| Dif183 without N-terminal Cyst | 361 |
| Dif14 (Forward Primer) | 362 |
| Dif14 (Reverse Primer) | 363 |
| Dif15 (Forward Primer) | 364 |
| Dif15(Reverse Primer) | 365 |
| Dif16 (Forward Primer) | 366 |
| Dif16 (Reverse Primer) | 367 |
| Dif40 (Forward Primer) | 368 |
| Dif40 (reverse Primer) | 369 |
| Dif44 (Forward Primer) | 370 |
| Dif44 (Reverse Primer) | 371 |
| Dif51 (Forward Primer) | 372 |
| Dif51 (Reverse Primer) | 373 |
| Dif55 (Forward Primer) | 374 |
| Dif55 (Reverse Primer) | 375 |
| Dif104 (Forward Primer) | 376 |
| Dif104 (Reverse Primer) | 377 |
| Dif114 (Forward Primer) | 378 |
| Dif114 (Reverse Primer) | 379 |
| Dif130 (Forward Primer) | 380 |
| Dif130 (Reverse Primer) | 381 |
| Dif144 (Forward Primer) | 382 |
| Dif144 (Reverse Primer) | 383 |
| Dif192 (Forward Primer) | 384 |
| Dif192 (Reverse Primer) | 385 |
| Dif194 (Forward Primer) | 386 |
| Dif194 (Reverse Primer) | 387 |
| Dif201 (Forward Primer) | 388 |
| Dif201 (Reverse Primer) | 389 |
| Dif210 (Forward Primer) | 390 |
| Dif210 (Reverse Primer) | 391 |
| Dif211 (Forward Primer) | 392 |
| Dif211 (Reverse Primer) | 393 |
| Dif212 (Forward Primer) | 394 |
| Dif212 (Reverse Primer) | 395 |
| Dif225 (Forward Primer) | 396 |
| Dif225 (Reverse Primer) | 397 |
| Dif231 (Forward Primer) | 398 |
| Dif231 (Reverse Primer) | 399 |
| Dif232 (Forward Primer) | 400 |
| Dif232 (Reverse Primer) | 401 |
| Dif189A f28-498 (Forward Primer) | 402 |
| Dif189A f28-498 (Reverse Primer) | 403 |
| Dif189B f521-1622 (Forward Primer) | 404 |
| Dif189B f521-1622 (Reverse Primer) | 405 |
| Dif109A f1-539 (Forward Primer) | 406 |
| Dif109A f1-539 (Reverse Primer) | 407 |
| Dif109B f541-1132 (Forward Primer) | 408 |
| Dif109B f541-1132 (Reverse Primer) | 409 |
| Dif171A f22-568 (Forward Primer) | 410 |
| Dif171A f22-568 (Reverse Primer) | 411 |
| Dif171B f561-976 (Forward Primer) | 412 |
| Dif171B f561-976 (Reverse Primer) | 413 |
| Dif208A f32-480 (Forward Primer) | 414 |
| Dif208A f32-480 (Reverse Primer) | 415 |
| Dif208B f481-938 (Forward Primer) | 416 |
| Dif208B f481-938 (Reverse Primer) | 417 |
| Dif14A (Forward Primer) | 418 |
| Dif14A (Reverse Primer) | 419 |
| Dif14B(Forward Primer) | 420 |
| Dif14B(Reverse Primer) | 421 |
| DIF208 (Forward Primer) | 422 |
| DIF208 (Reverse Primer) | 423 |
| DIF183 (Forward Primer) | 424 |
| DIF183 (Reverse Primer) | 425 |
| DIF106A | 426 |
| DIF106A | 427 |

-continued

| Description | SEQ ID: |
|---|---|
| DIF106C | 428 |
| DIF106C | 429 |
| DIF14A cloned | 430 |
| DIF14A cloned | 431 |
| DIF208 (cloned)DNA | 432 |
| DIF208 (cloned) aa | 433 |
| Dif153 WT in pet15TEV | 434 |
| DIF153 WT (unmodified) | 435 |
| Dif153 E143A pet15TEV | 436 |
| DIF153 E143A | 437 |
| Dif153 H150A pet15TEV | 438 |
| DIF153 H150A | 439 |
| Dif153 Y178F pet15TEV | 440 |
| DIF153 Y178F | 441 |
| Dif153 C208S pet15TEV | 442 |
| DIF153 Cys208S | 443 |
| Dif153 H142A in pet15TEV | 444 |
| DIF153 H142A | 445 |
| Dif153 H146A in pet15TEV | 446 |
| DIF153 H146A | 447 |
| Dif153 H142A, H146A in pet15TEV | 448 |
| DIF153 H142A/H146A | 449 |
| Dif153 H142A/E143A pet15TEV | 450 |
| DIF153 H142A/E143A | 451 |
| Dif153 H142A/E143R pet15TEV | 452 |
| DIF153 H142A/E143R | 453 |
| Dif153 H142A/Y178F pet15TEV | 454 |
| DIF153 H142A/Y178F | 455 |
| Dif153 E143A/Y178F pet15TEV | 456 |
| DIF153 E143A/Y178F | 457 |
| Dif153 H142A/H150A pet15TEV | 458 |
| DIF153 H142A/H150A | 459 |
| Dif153 E143A/D149A pet15TEV | 460 |
| DIF153 E143A/D149A | 461 |
| Dif153 D149A pet15TEV | 462 |
| DIF153 D149A | 463 |
| Dif153 E143R | 464 |
| DIF153 E143R | 465 |
| DIF153 H142A (Forward Primer) | 466 |
| DIF153 H142A(Reverse Primer) | 467 |
| Dif153 H146A (Forward Primer) | 468 |
| DIF153 H146A (Reverse Primer) | 469 |
| DIF153 H142A, H146A (Forward Primer) | 470 |
| DIF153 H142A, H146A (Reverse Primer) | 471 |
| Dif153 E143A(Forward Primer) | 472 |
| Dif153 E143A (Reverse Primer) | 473 |

REFERENCES

[1] Sebaihia et al. (2006) *Nat. Genetics* 38:779-786.
[2] Rupnik et al. (2009) *Nat. Rev. Microbiol.* 7:526-536.
[3] Barbut et al. (2000) *J. Clin. Microbiol.* 38:2386-2388.
[4] Dzink and Bartlett (1980) *Antimicrobial Agents and Chemotherapy* 17:695-698.
[5] Musher et al. (2006) *The Journal of Antimicrobial Chemotherapy* 59:705-710.
[6] Dudley et al. (1986) *Arch. Intern. Med.* 146:1101-1104.
[7] Kink and Williams (1998) *Infection and Immunity* 66:2018-2025.
[8] Aboudola et al. (2003) *Infection and Immunity* 71:1608-1610.
[9] Geysen et al. (1984) *PNAS* USA 81:3998-4002.
[10] Carter (1994) *Methods Mol Biol* 36:207-23.
[11] Jameson, B A et al. 1988. *CABIOS* 4(1):181-186.
[12] Raddrizzani & Hammer (2000) *Brief Bioinform* 1(2):179-89.
[13] Bublil et al. (2007) *Proteins* 68(1):294-304.
[14] De Lalla et al. (1999) *J. Immunol.* 163:1725-29.
[15] Kwok et al. (2001) *Trends Immunol* 22:583-88.
[16] Brusic et al. (1998) *Bioinformatics* 14(2):121-30
[17] Meister et al. (1995) *Vaccine* 13(6):581-91.
[18] Roberts et al. (1996) *AIDS Res Hum Retroviruses* 12(7):593-610.
[19] Maksyutov & Zagrebelnaya (1993) *Comput Appl Biosci* 9(3):291-7.
[20] Feller & de la Cruz (1991) *Nature* 349(6311):720-1.
[21] Hopp (1993) polypeptide *Research* 6:183-190.
[22] Welling et al. (1985) *FEBS Lett.* 188:215-218.
[23] Davenport et al. (1995) *Immunogenetics* 42:392-297.
[24] Tsurui & Takahashi (2007) *J Pharmacol Sci.* 105(4):299-316.
[25] Tong et al. (2007) *Brief Bioinform.* 8(2):96-108.
[26] Schirle et al. (2001) *J Immunol Methods.* 257(1-2):1-16.
[27] Chen et al. (2007) *Amino Acids* 33(3):423-8.
[28] Donnelly et al. (1997) *Annu Rev Immunol* 15:617-648.
[29] Strugnell et al. (1997) *Immunol Cell Biol* 75(4):364-369.
[30] Cui (2005) *Adv Genet* 54:257-89.
[31] Robinson & Torres (1997) *Seminars in Immunol* 9:271-283.
[32] Brunham et al. (2000) *J Infect Dis* 181 Suppl 3:S538-43.
[33] Svanholm et al. (2000) *Scand J Immunol* 51(4):345-53.
[34] *DNA Vaccination—Genetic Vaccination* (1998) eds. Koprowski et at (ISBN 3540633928).
[35] *Gene Vaccination: Theory and Practice* (1998) ed. Raz (ISBN 3540644288).
[36] U.S. Pat. No. 5,707,829
[37] *Current Protocols in Molecular Biology* (F. M. Ausubel et al. eds., 1987) Supplement 30.
[38] Findeis et al, *Trends Biotechnol.* (1993) 11:202
[39] Chiou et al. (1994) *Gene Therapeutics: Methods And Applications Of Direct Gene Transfer.* ed. Wolff
[40] Wu et al., *J. Biol. Chem.* (1988) 263:621
[41] Wu et al., *J. Biol. Chem.* (1994) 269:542
[42] Zenke et al., *Proc. Natl. Acad. Sci.* (USA) (1990) 87:3655
[43] Wu et al., *J. Biol. Chem.* (1991) 266:338
[44] Jolly, *Cancer Gene Therapy* (1994) 1:51
[45] Kimura, *Human Gene Therapy* (1994) 5:845
[46] Connelly, *Human Gene Therapy* (1995) 1:185
[47] Kaplitt, *Nature Genetics* (1994) 6:148
[48] WO 90/07936.
[49] WO 94/03622.
[50] WO 93/25698.
[51] WO 93/25234.
[52] U.S. Pat. No. 5,219,740.
[53] WO 93/11230.
[54] WO 93/10218.
[55] U.S. Pat. No. 4,777,127.
[56] GB Patent No. 2,200,651.
[57] EP-A-0345242.
[58] WO 91/02805.

[59] WO 94/12649.
[60] WO 93/03769.
[61] WO 93/19191.
[62] WO 94/28938.
[63] WO 95/11984.
[64] WO 95/00655.
[65] Curiel, *Hum. Gene Ther.* (1992) 3:147
[66] Wu, *J. Biol. Chem.* (1989) 264:16985
[67] U.S. Pat. No. 5,814,482.
[68] WO 95/07994.
[69] WO 96/17072.
[70] WO 95/30763.
[71] WO 97/42338.
[72] WO 90/11092.
[73] U.S. Pat. No. 5,580,859
[74] U.S. Pat. No. 5,422,120
[75] WO 95/13796.
[76] WO 94/23697.
[77] WO 91/14445.
[78] EP-0524968.
[79] Philip, *Mol. Cell Biol.* (1994) 14:2411
[80] Woffendin, *Proc. Natl. Acad. Sci.* (1994) 91:11581
[81] U.S. Pat. No. 5,206,152.
[82] WO 92/11033.
[83] U.S. Pat. No. 5,149,655.
[84] Winter et al., (1991) *Nature* 349:293-99
[85] U.S. Pat. No. 4,816,567.
[86] Inbar et al., (1972) *Proc. Natl. Acad. Sci. U.S.A.* 69:2659-62.
[87] Ehrlich et al., (1980) *Biochem* 19:4091-96.
[88] Huston et al., (1988) *Proc. Natl. Acad. Sci. U.S.A.* 85:5897-83.
[89] Pack et al., (1992) *Biochem* 31, 1579-84.
[90] Cumber et al., (1992) *J. Immunology* 149B, 120-26.
[91] Riechmann et al., (1988) *Nature* 332, 323-27.
[92] Verhoeyan et al., (1988) *Science* 239, 1534-36.
[93] GB 2,276,169.
[94] Gennaro (2000) *Remington: The Science and Practice of Pharmacy.* 20th edition, ISBN: 0683306472.
[95] *Vaccine Design* (1995) eds. Powell & Newman. ISBN: 030644867X. Plenum.
[96] WO90/14837.
[97] WO90/14837.
[98] Podda & Del Giudice (2003) *Expert Rev Vaccines* 2:197-203.
[99] Podda (2001) *Vaccine* 19: 2673-2680.
[100] *Vaccine Design: The Subunit and Adjuvant Approach* (eds. Powell & Newman) Plenum Press 1995 (ISBN 0-306-44867-X).
[101] *Vaccine Adjuvants: Preparation Methods and Research Protocols* (Volume 42 of *Methods in Molecular Medicine* series). ISBN: 1-59259-083-7. Ed. O'Hagan.
[102] U.S. Pat. No. 5,057,540.
[103] Niikura et al. (2002) *Virology* 293:273-280.
[104] Lenz et al. (2001) *J Immunol* 166:5346-5355.
[105] Pinto et al. (2003) *J Infect Dis* 188:327-338.
[106] Gerber et al. (2001) *J Viral* 75:4752-4760.
[107] WO03/024480.
[108] WO03/024481.
[109] Gluck et al. (2002) *Vaccine* 20:B10-B16.
[110] Meraldi et al. (2003) *Vaccine* 21:2485-2491.
[111] Pajak et al. (2003) *Vaccine* 21:836-842.
[112] Krieg (2003) *Nature Medicine* 9:831-835.
[113] McCluskie et al. (2002) *FEMS Immunology and Medical Microbiology* 32:179-185.
[114] WO98/40100.
[115] U.S. Pat. No. 6,207,646.
[116] U.S. Pat. No. 6,239,116.
[117] U.S. Pat. No. 6,429,199.
[181] Schellack et al. (2006) *Vaccine* 24:5461-72.
[119] Johnson et al. (1999) *Bioorg Med Chem Lett* 9:2273-2278.
[120] Evans et al. (2003) *Expert Rev Vaccines* 2:219-229.
[121] Beignon et al. (2002) *Infect Immun* 70:3012-3019.
[122] Pizza et al. (2001) *Vaccine* 19:2534-2541.
[123] Pizza et al. (2000) *Int J Med Microbiol* 290:455-461.
[124] Scharton-Kersten et al. (2000) *Infect Immun* 68:5306-5313.
[125] Ryan et al. (1999) *Infect Immun* 67:6270-6280.
[126] Partidos et al. (1999) *Immunol Lett* 67:209-216.
[127] Peppoloni et al. (2003) *Expert Rev Vaccines* 2:285-293.
[128] Pine et al. (2002) *J Control Release* 85:263-270.
[129] WO99/40936.
[130] WO99/44636.
[131] Singh et al] (2001) *J Cont Release* 70:267-276.
[132] WO99/27960.
[133] U.S. Pat. No. 6,090,406.
[134] U.S. Pat. No. 5,916,588.
[135] EP-A-0626169.
[136] WO99/52549.
[137] Andrianov et al. (1998) *Biomaterials* 19:109-115.
[138] Payne et al. (1998) *Adv Drug Delivery Review* 31:185-196.
[139] Stanley (2002) *Clin Exp Dermatol* 27:571-577.
[140] Jones (2003) *Curr Opin Investig Drugs* 4:214-218.
[141] WO99/11241.
[142] WO94/00153.
[143] WO98/57659.
[144] European patent applications 0835318, 0735898 and 0761231.
[145] Ogunniyi et al. (2001) *Infect Immun* 69:5997-6003.
[146] WO2006/110603.
[147] WO2009/033268
[148] *Research Disclosure.* 453077 (January 2002).
[149] EP-A-0372501.
[150] EP-A-0378881.
[151] EP-A-0427347.
[152] WO93/17712.
[153] WO94/03208.
[154] WO98/58668.
[155] EP-A-0471177.
[156] WO91/01146.
[157] Falugi et al. (2001) *Eur J Immunol* 31:3816-3824.
[158] Baraldo et al. (2004) *Infect Immun* 72(8):4884-7.
[159] EP-A-0594610.
[160] Ruan et al. (1990) *J Immunol* 145:3379-3384.
[161] WO00/56360.
[162] Kuo et al. (1995) *Infect Immun* 63:2706-13.
[163] Michon et al. (1998) *Vaccine.* 16:1732-41.
[164] WO02/091998.
[165] WO01/72337.
[166] WO00/61761.
[167] WO00/33882
[168] U.S. Pat. No. 4,761,283.
[169] U.S. Pat. No. 4,882,317.
[170] U.S. Pat. No. 4,695,624.
[171] *Mol. Immunol.,* 1985, 22, 907-919
[172] EP-A-0208375.
[173] Bethell G. S. et al., *J. Biol. Chem.,* 1979, 254, 2572-4
[174] Hearn M. T. W., *J. Chromatogr.,* 1981, 218, 509-18
[175] WO00/10599.
[176] Gever et al., *Med. Microbiol. Immunol,* 165: 171-288 (1979).

[177] U.S. Pat. No. 4,057,685.
[178] U.S. Pat. Nos. 4,673,574; 4,761,283; 4,808,700.
[179] U.S. Pat. No. 4,459,286.
[180] U.S. Pat. No. 4,965,338.
[181] U.S. Pat. No. 4,663,160.
[182] WO2007/000343.
[183] WO98/04702
[184] WO99/24578, WO99/36544, WO99/57280, WO00/22430, Tettelin et al. (2000) *Science* 287:1809-1815, Pizza et al. (2000) *Science* 287:1816-1820 and WO96/29412
[185] WO01/52885; Bjune et al. (1991) *Lancet* 338(8775): 1093-1096; Fukasawa et al. (1999) *Vaccine* 17:2951-2958; Rosenqvist et al. (1998) *Dev. Biol. Stand* 92:323-333
[186] Costantino et al. (1992) *Vaccine* 10:691-698
[187] Costantino et al. (1999) *Vaccine* 17:1251-1263
[188] e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207
[189] e.g. Bell (2000) *Pediair Infect Dis J* 19:1187-1188; Iwarson (1995) *APMIS* 103:321-326
[190] Gerlich et al. (1990) *Vaccine* 8 Suppl:S63-68 & 79-80
[191] Hsu et al. (1999) *Clin Liver Dis* 3:901-915
[192] Gustafsson et al. (1996) *N. Engl. J. Med.* 334:349-355; Rappuoli et al. (1991) *TIBTECH* 9:232-238
[193] chapter 3 of *Vaccines* (1988) eds. Plotkin & Mortimer. ISBN 0-7216-1946-0
[194] Del Guidice et al. (1998) *Molecular Aspects of Medicine* 19:1-70
[195] chapter 4 of *Vaccines* (1988) eds. Plotkin & Mortimer. ISBN 0-7216-1946-0
[196] WO99/24578, WO99/36544, WO99/57280
[197] PCT/IB01/01445; Kalman et al. (1999) *Nature Genetics* 21:385-389; Read et al. (2000) *Nucleic Acids Res* 28:1397-406; Shirai et al. (2000) *J. Infect. Dis.* 181(Suppl 3):S524-S527; WO99/27105; WO00/27994; WO00/37494
[198] WO99/28475
[199] Ross et al. (2001) *Vaccine* 19:4135-4142
[200] Sutter et al. (2000) *Pediatr Clin North Am* 47:287-308; Zimmerman & Spann (1999) *Am Fam Physician* 59:113-118, 125-126
[201] Dreesen (1997) *Vaccine* 15 Suppl:S2-6
[202] *MMWR Morb Mortal Wkly Rep* 1998 Jan. 16; 47(1): 12, 19
[203] Chapters 9, 10 & 11 of *Vaccines* (1988) eds Plotkin & Mortimer. ISBN 0-7216-1946-0
[204] Chapter 19 of *Vaccines* (1988) eds Plotkin & Mortimer. ISBN 0-7216-1946-0
[205] McMichael (2000) *Vaccine* 19 Suppl 1:S101-107
[206] Kuroda et al. (2001) *Lancet* 357(9264):1225-1240; see also pages 1218-1219
[207] Schuchat (1999) *Lancet* 353(9146):51-6.
[208] WO02/34771.
[209] Kuroda et al. (2001) *Lancet* 357(9264):1225-1240; see also pages 1218-1219
[210] Rice et al. (2000) *Trends Genet* 16:276-277.
[211] Needleman & Wunsch (1970) *J. Mol. Biol.* 48, 443-453.
[212] Gennaro (2000) *Remington: The Science and Practice of Pharmacy.* 20th edition, ISBN: 0683306472.
[213] *Methods in Enzymology* (S. Colowick and N. Kaplan, eds., Academic Press, Inc.)
[214] *Handbook of Experimental Immunology*, Vols. I-IV (D. M. Weir and C. C. Blackwell, eds, 1986, Blackwell Scientific Publications)
[215] Sambrook et al. (2001) *Molecular Cloning: A Laboratory Manual,* 3rd edition (Cold Spring Harbor Laboratory Press).
[216] *Handbook of Surface and Colloidal Chemistry* (Birdi, K. S. ed., CRC Press, 1997)
[217] Ausubel et al. (eds) (2002) *Short protocols in molecular biology,* 5th edition (Current Protocols).
[218] *Molecular Biology Techniques: An Intensive Laboratory Course,* (Ream et al., eds., 1998, Academic Press)
[219] *PCR (Introduction to Biotechniques Series),* 2nd ed. (Newton & Graham eds., 1997, Springer Verlag)
[220] Gardy et al. (2005) *Bioinformatics* 21: 617-23

SEQUENCE LISTING (474 sequences)

SEQ ID NO: 1 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 2 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 3 - protein, 769 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 4 - protein, 541 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 5 - protein, 228 aa, Clostridium difficile
LSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 6 - protein, 1039 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDR

SEQ ID NO: 7 - protein, 266 aa, Clostridium difficile
AEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSF

SEQ ID NO: 8 - protein, 902 aa, Clostridium difficile
DHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 9 - protein, 204 aa, Clostridium difficile
RYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLN

SEQ ID NO: 10 - protein, 457 aa, Clostridium difficile
ILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 11 - protein, 320 aa, Clostridium difficile
ASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 12 - protein, 864 aa, Clostridium difficile
FDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 13 - protein, 403 aa, Clostridium difficile
YQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 14 - protein, 872 aa, Clostridium difficile
SLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 15 - protein, 743 aa, Clostridium difficile
AVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 16 - protein, 816 aa, Clostridium difficile
MQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAP

SEQ ID NO: 17 - protein, 767 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEES

SEQ ID NO: 18 - protein, 543 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 19 - protein, 224 aa, Clostridium difficile
GEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEES

SEQ ID NO: 20 - protein, 1066 aa, Clostridium difficile
IIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVS

SEQ ID NO: 21 - protein, 514 aa, Clostridium difficile
ITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 22 - protein, 210 aa, Clostridium difficile
VQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 23 - protein, 311 aa, Clostridium difficile
YSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 24 - protein, 872 aa, Clostridium difficile
HMSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGSGGGGASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPLE

SEQ ID NO: 25 - protein, 6 aa, Artificial Sequence
  Linker
GSGGGG

SEQ ID NO: 26 - protein, 8 aa, Artificial Sequence
  Linker
GSGSGGGG

SEQ ID NO: 27 - protein, 5 aa, Artificial Sequence
  Linker
AAALE

SEQ ID NO: 28 - protein, 26 aa, Artificial Sequence
  IC-31
ICICICICICICICICICICICICIC

SEQ ID NO: 29 - protein, 11 aa, Artificial Sequence
  Polycationic polymer
KLKLLLLLKLK

SEQ ID NO: 30 - DNA, 8133 bp, Artificial Sequence
  Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 31 - DNA, 7101 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 32 - DNA, 2307 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagct

SEQ ID NO: 33 - DNA, 1623 bp, Clostridium difficile
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatct

SEQ ID NO: 34 - DNA, 684 bp, Clostridium difficile
tctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctctt

SEQ ID NO: 35 - DNA, 3114 bp, Clostridium difficile
atgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggtgattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatattattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagataga

SEQ ID NO: 36 - DNA, 798 bp, Clostridium difficile
gaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatatcaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaat

SEQ ID NO: 37 - DNA, 2649 bp, Clostridium difficile
gatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatcgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggctaa

SEQ ID NO: 38 - DNA, 612 bp, Clostridium difficile
agatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaat

SEQ ID NO: 39 - DNA, 1371 bp, Clostridium difficile
atcctgcagaacggctatatcaccatcgaacgtaataacttctacttcgatgccaataacgaatccaaaatggtgacgggcgtgtttaaaggcccaaatggttttgagtatttcgcgccggcaaacacccacaataacaacattgaaggtcaagccattgtttaccaaaacaaattcctgaccctaaatggaaaaaaatattactttgataacgacagcaaagcggtcaccggctggcagacaatcgacggtaaaaaatattactttaatcttaacaccgcagaagcggccaccggctggcaaaccatcgatggtaaaaaatattacttcaacttgaacaccgcagaagcggccaccggctggcagaccatcgatggtaaaaaatactactttaataccaacaccttcattgctagcaccggttatacttcgatcaacggtaaacatttttactttaataccgacggtatcatgcaaattggcgtattcaaaggtcctaacggctttgaatactttgcgccagcaaatacccacaacaataacattgaaggtcaggccattctgtaccaaaacaaattcctgaccctaaatggtaaaaaatattacttcggtagtgacagcaaagcggttacaggcctaaggaccatcgatggtaaaaaatattactttaacaccaacaccgcagtcgcggttaccggctggcagaccatcaatggtaaaaaatactactttaacaccaacacctctattgccagcaccggttacacgatcatctcgggtaaacatttctattttaataccgatggtatcatgcaaattggcgtatttaaaggtccggacggcttcgaatactttgcgcctgcaaacacggatgccaacaatattgagggtcaggcaattagatatcaaaaccgcttcctctacctgcatgacaatatttattactttggtaacaatagcaaagcggccaccggttgggtgaccatcgatggtaaccgttattacttcgagccaaatacggcaatgggtgctaacggttataaaaccatcgacaataaaaacttctactttcgcaatggtctgccgcaaattggcgtatttaaaggatctaacggcttcgaatactttgcgcctgccaatacagatgcaaacaacattgaaggtcaggccattagataccaaaatcgtttcctccatttacttggcaaaatttattactttggtaacaatagcaaagcggtcaccggttggcaaaccatcaacggtaaagtgtattactttatgccagataccgcaatggccgcggcaggtggcttgttcgagatcgacggtgttatttacttcttcggtgtcgatggcgtgaaagctccg

SEQ ID NO: 40 - DNA, 955 bp, Clostridium difficile
gcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaag

SEQ ID NO: 41 - DNA, 2592 bp, Clostridium difficile
tttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccct

SEQ ID NO: 42 - DNA, 807 bp, Clostridium difficile
taccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccct

SEQ ID NO: 43 - DNA, 2616 bp, Clostridium difficile
tcattattctattttgatcctatagaatttaacttagtaactggatggcaaactatcaatggtaaaaaatattattttgatataaatactggagcagctttaattagttataaaattattaatggtaaacacttttattttaataatgatggtgtgatgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccctgggatatatggc

SEQ ID NO: 44 - DNA, 2229 bp, Clostridium difficile
gcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccct

SEQ ID NO: 45 - DNA, 2448 bp, Clostridium difficile
atgcagttgggagtatttaaaggacctgatggatttgaatattttgcacctgccaatactcaaaataataacatagaaggtcaggctatagtttatcaaagtaaattcttaactttgaatggcaaaaaatattattttgataatgactcaaaagcagtcactggatggagaattattaacaatgagaaatattactttaatcctaataatgctattgctgcagtcggattgcaagtaattgacaataataagtattatttcaatcctgacactgctatcatctcaaaaggttggcagactgttaatggtagtagatactactttgatactgataccgctattgcctttaatggttataaaactattgatggtaaacacttttattttgatagtgattgtgtagtgaaaataggtgtgtttagtacctctaatggatttgaatattttgcacctgctaatacttataataataacatagaaggtcaggctatagtttatcaaagtaaattcttaactttgaatggtaaaaaatattactttgataataactcaaaagcagttaccggatggcaaactattgatagtaaaaaatattactttaatactaacactgctgaagcagctactggatggcaaactattgatggtaaaaaatattactttaatactaacactgctgaagcagctactggatggcaaactattgatggtaaaaaatattactttaatactaacactgctatagcttcaactggttatacaattattaatggtaaacatttttattttaatactgatggtattatgcagataggagtgtttaaaggacctaatggatttgaatattttgcacctgctaatacggatgctaacaacatagaaggtcaagctatactttaccaaaatgaattcttaactttgaatggtaaaaaatattactttggtagtgactcaaaagcagttactggatggagaattattaacaataagaaatattactttaatcctaataatgctattgctgcaattcatctatgcactataaataatgacaagtattactttagttatgatggaattcttcaaaatggatatattactattgaaagaaataatttctattttgatgctaataatgaatctaaaatggtaacaggagtatttaaaggacctaatggatttgagtattttgcacctgctaatactcacaataataacatagaaggtcaggctatagtttaccagaacaaattcttaactttgaatggcaaaaaatattattttgataatgactcaaaagcagttactggatggcaaaccattgatggtaaaaaatattactttaatcttaacactgctgaagcagctactggatggcaaactattgatggtaaaaaatattactttaatcttaacactgctgaagcagctactggatggcaaactattgatggtaaaaaatattactttaatactaacactttcatagcctcaactggttatacaagtattaatggtaaacatttttattttaatactgatggtattatgcagataggagtgtttaaaggacctaatggatttgaatactttgcacctgctaatactcataataataacatagaaggtcaagctatactttaccaaaataaattcttaactttgaatggtaaaaaatattactttggtagtgactcaaaagcagttaccggattgcgaactattgatggtaaaaaatattactttaatactaacactgctgttgcagttactggatggcaaactattaatggtaaaaaatactactttaatactaacacttctatagcttcaactggttatacaattattagtggtaaacatttttattttaatactgatggtattatgcagataggagtgtttaaaggacctgatggatttgaatactttgcacctgctaatacagatgctaacaatatagaaggtcaagctatacgttatcaaaatagattcctatatttacatgacaatatatattattttggtaataattcaaaagcagctactggttgggtaactattgatggtaatagatattacttcgagcctaatacagctatgggtgcgaatggttataaaactattgataataaaaatttttactttagaaatggtttacctcagataggagtgtttaaagggtctaatggatttgaatactttgcacctgctaatacggatgctaacaatatagaaggtcaagctatacgttatcaaaatagattcctacatttacttggaaaaatatattactttggtaataattcaaaagcagttactggatggcaaactattaatggtaaagtatattactttatgcctgatactgctatggctgcagctggtggacttttcgagattgatggtgttatatatttctttggtgttgatggagtaaaagcccct

SEQ ID NO: 46 - DNA, 2301 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagt

SEQ ID NO: 47 - DNA, 1629 bp, Clostridium difficile
atgagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgtttggattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctctt

SEQ ID NO: 48 - DNA, 672 bp, Clostridium difficile
ggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagt

SEQ ID NO: 49 - DNA, 3198 bp, Clostridium difficile
attataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatct

SEQ ID NO: 50 - DNA, 1545 bp, Clostridium difficile
ataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 51 - DNA, 633 bp, Clostridium difficile
gttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaatag

SEQ ID NO: 52 - DNA, 933 bp, Clostridium difficile
tattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggtgaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaa

SEQ ID NO: 53 - DNA, 2616 bp, Artificial Sequence
  B4 hybrid
catatgagtctggttaaccgtaaacaactggaaaaaatggcgaatgtgcgctttagaacccaggaagatgaatatgttgcgattctagatgcactggaagaataccataacatgtcagagaataccgtggtagaaaaatatctgaaactgaaagatattaactctctgacggatatctatattgacacgtacaaaaaaagcggtcgtaataaagctctgaaaaaatttaaggaatatctcgttacggaagtgctggagctcaagaacaataacctgaccccggttgagaaaaatctgcatttcgtttggatcggcggtcagattaacgacaccgccatcaattacattaaccagtggaaagatgtgaatagcgattataacgttaatgtcttttatgactcgaacgcgtttctaattaacacgctaaaaaaaaccgtggtggaaagcgcgattaatgatactcttgagagctttcgcgaaaacctgaacgacccacgtttcgactacaataaattcttccgcaaaagaatggaaattatctatgataaacaaaaaaacttcattaactactataaagcacaacgtgaagaaaatccggaactgattatcgacgatatcgtgaagacgtacttgagcaacgagtatagcaaggagattgatgaacttaatacatacatcgaagaatcactgaacaaaatcacgcaaaatagtggcaacgacgttcgcaactttgaggaatttaaaaatggcgagagcttcaacttatatgaacaggagctagtggaacgatggaacctggccgcagcctccgcgattctggcgatttctgcgctgaaagaaatcggtggtatggcgctggcggtcgcgatgctgccgggcattcagccggacctgtttgagtccattgagaaacctagtagcgtgacggtagacttctgggaaatgacgaagttagaagcaattatgaaatacaaagaatatattccggaatacacaagcgaacactttgacatgctggacgaggaagttcagtcgagctttgaatctgtcctcgccagcaagagcgataaaagcgaaattttcagcagcctgggtgatatggaggcgagcccgctcgaagttaaaatcgcgtttaattcgaagggtatcattaaccaaggactcatctccgtaaaagacagctattgttcaaatctgattgtgaaacagatagagaaccgctataaaattctaaataacagtctgaatccggcaatctcagaggacaacgatttcaataccactacaaacacatttatcgatagtattatggccgaagcaaatgcggacaacggtcgttttatgatggaactcggtaagtacctgcgcgtcggtttcttcccggatgttaaaaccaccatcaacttatcgggaccagaagcgtatgctgcggcctaccaggatctgctgatgtttaaagaaggaagcatgaatatacatctaattgaagcagacctgcgtaacttcgagatatctaaaaccaacatctcccaaagcaccgaacaggaaatggcctcactgtggagctttgacgatgcgcgcgcaaaagcccagtttgaagaatataaacgaaattactttgaaggtagcttgggatccggagggggtggtgctagcaccggttatacttcgatcaacggtaaacatttttactttaataccgacggtatcatgcaaattggcgtattcaaaggtcctaacggctttgaatactttgcgccagcaaatacccacaacaataacattgaaggtcaggccattctgtaccaaaacaaattcctgaccctaaatggtaaaaaatattacttcggtagtgacagcaaagcggttacaggcctaaggaccatcgatggtaaaaaatattactttaacaccaacaccgcagtcgcggttaccggctggcagaccatcaatggtaaaaaatactactttaacaccaacacctctattgccagcaccggttacacgatcatctcgggtaaacatttctattttaataccgatggtatcatgcaaattggcgtatttaaaggtccggacggcttcgaatactttgcgcctgcaaacacggatgccaacaatattgagggtcaggcaattagatatcaaaaccgcttcctctacctgcatgacaatatttattactttggtaacaatagcaaagcggccaccggttgggtgaccatcgatggtaaccgttattacttcgagccaaatacggcaatgggtgctaacggttataaaaccatcgacaataaaaacttctactttcgcaatggtctgccgcaaattggcgtatttaaaggatctaacggcttcgaatactttgcgcctgccaatacagatgcaaacaacattgaaggtcaggccattagataccaaaatcgtttcctccatttacttggcaaaatttattactttggtaacaatagcaaagcggtcaccggttggcaaaccatcaacggtaaagtgtattactttatgccagataccgcaatggccgcggcaggtggcttgttcgagatcgacggtgttatttacttcttcggtgtcgatggcgtgaaagctccgctcgag

SEQ ID NO: 54 - protein, 769 aa, Artificial Sequence
  Mutated sequence
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEA

SEQ ID NO: 55 - DNA, 2307 bp, Artificial Sequence
  Mutated sequence
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtagccttagccgttgccatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagct

SEQ ID NO: 56 - protein, 541 aa, Artificial Sequence
  Mutated sequence
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVALAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGS

SEQ ID NO: 57 - DNA, 1623 bp, Artificial Sequence
  Mutated sequence
atgtctttaatatctaaagaagagttaataaaactcgcatatagcattagaccaagagaaaatgagtataaaactatactaactaatttagacgaatataataagttaactacaaacaataatgaaaataaatatttacaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtatggataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtagccttagccgttgccatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatct

SEQ ID NO: 58 - protein, 766 aa, Artificial Sequence
  Mutated sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 59 - DNA, 2303 bp, Artificial Sequence
  Mutated sequence
ggcagtctggttaaccgtaaacaactggaaaaaatggcgaatgtgcgctttagaacccaggaagatgaatatgttgcgattctagatgcactggaagaataccataacatgtcagagaataccgtggtagaaaaatatctgaaactgaaagatattaactctctgacggatatctatattgacacgtacaaaaaaagcggtcgtaataaagctctgaaaaaatttaaggaatatctcgttacggaagtgctggagctcaagaacaataacctgaccccggttgagaaaaatctgcatttcgtttggatcggcggtcagattaacgacaccgccatcaattacattaaccagtggaaagatgtgaatagcgattataacgttaatgtcttttatgactcgaacgcgtttctaattaacacgctaaaaaaaaccgtggtggaaagcgcgattaatgatactcttgagagctttcgcgaaaacctgaacgacccacgtttcgactacaataaattcttccgcaaaagaatggaaattatctatgataaacaaaaaaacttcattaactactataaagcacaacgtgaagaaaatccggaactgattatcgacgatatcgtgaagacgtacttgagcaacgagtatagcaaggagattgatgaacttaatacatacatcgaagaatcactgaacaaaatcacgcaaaatagtggcaacgacgttcgcaactttgaggaatttaaaaatggcgagagcttcaacttatatgaacaggagctagtggaacgatggaacctggccgcagcctccgcgattctggcgatttctgcgctgaaagaaatcggtggtatggcgctggcggtcgcgatgctgccgggcattcagccggacctgtttgagtccattgagaaacctagtagcgtgacggtagacttctgggaaatgacgaagttagaagcaattatgaaatacaaagaatatattccggaatacacaagcgaacactttgacatgctggacgaggaagttcagtcgagctttgaatctgtcctcgccagcaagagcgataaaagcgaaattttcagcagcctgggtgatatggaggcgagcccgctcgaagttaaaatcgcgtttaattcgaagggtatcattaaccaaggactcatctccgtaaaagacagctattgttcaaatctgattgtgaaacagatagagaaccgctataaaattctaaataacagtctgaatccggcaatctcagaggacaacgatttcaataccactacaaacacatttatcgatagtattatggccgaagcaaatgcggacaacggtcgttttatgatggaactcggtaagtacctgcgcgtcggtttcttcccggatgttaaaaccaccatcaacttatcgggaccagaagcgtatgctgcggcctaccaggatctgctgatgtttaaagaaggaagcatgaatatacatctaattgaagcagacctgcgtaacttcgagatatctaaaaccaacatctcccaaagcaccgaacaggaaatggcctcactgtggagctttgacgatgcgcgcgcaaaagcccagtttgaagaatataaacgaaattactttgaaggtagcttgggtgaagatgacaaccttgatttctctcaaaatattgtggtcgacaaggagtatctgctggaaaaaatttccagcttagcgcgttcgagcgagcgcggctatattcactacatcgttcaactgcagggcaacaaaatcagttatgaagcggcgtgcaacctgtttgcgaagaccccgtatgacagtgtgctatttcaaaaaaacattgaagatagcgagatcgcgtactattacaatcctggcgatggtgaaattcaggaaattgacaagtataaaatcccgtcgattatctctgaccgtccaaagatcaaactgacgtttatcggtgcgggtaaagatgaattcaacaccgatatttttgcgggttttgacgtggatagcctgtcaacggaaattgaagcggcgattgatttagcaaaagaggacatctccccgaagagcattgaaattaatctgctgggcgcgaacatgttttcatacagcataaacgtggaggagacctatcctggtaaactgctgttgaaagtcaaagataaaattagcgaattaatgccgtctattagccaagactccatcattgtgtcggcgaatcagtacgaagttcgcattaacagtgaaggccgtcgcgagctgctagatcattctggtgaatggattaataaagaagaaagtgg

SEQ ID NO: 60 - protein, 542 aa, Artificial Sequence
  Mutated sequence
SLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASAILAISALKEIGGMALAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 61 - DNA, 1626 bp, Artificial Sequence
  Mutated sequence
agtctggttaaccgtaaacaactggaaaaaatggcgaatgtgcgctttagaacccaggaagatgaatatgttgcgattctagatgcactggaagaataccataacatgtcagagaataccgtggtagaaaaatatctgaaactgaaagatattaactctctgacggatatctatattgacacgtacaaaaaaagcggtcgtaataaagctctgaaaaaatttaaggaatatctcgttacggaagtgctggagctcaagaacaataacctgaccccggttgagaaaaatctgcatttcgtttggatcggcggtcagattaacgacaccgccatcaattacattaaccagtggaaagatgtgaatagcgattataacgttaatgtcttttatgactcgaacgcgtttctaattaacacgctaaaaaaaaccgtggtggaaagcgcgattaatgatactcttgagagctttcgcgaaaacctgaacgacccacgtttcgactacaataaattcttccgcaaaagaatggaaattatctatgataaacaaaaaaacttcattaactactataaagcacaacgtgaagaaaatccggaactgattatcgacgatatcgtgaagacgtacttgagcaacgagtatagcaaggagattgatgaacttaatacatacatcgaagaatcactgaacaaaatcacgcaaaatagtggcaacgacgttcgcaactttgaggaatttaaaaatggcgagagcttcaacttatatgaacaggagctagtggaacgatggaacctggccgcagcctccgcgattctggcgatttctgcgctgaaagaaatcggtggtatggcgctggcggtcgcgatgctgccgggcattcagccggacctgtttgagtccattgagaaacctagtagcgtgacggtagacttctgggaaatgacgaagttagaagcaattatgaaatacaaagaatatattccggaatacacaagcgaacactttgacatgctggacgaggaagttcagtcgagctttgaatctgtcctcgccagcaagagcgataaaagcgaaattttcagcagcctgggtgatatggaggcgagcccgctcgaagttaaaatcgcgtttaattcgaagggtatcattaaccaaggactcatctccgtaaaagacagctattgttcaaatctgattgtgaaacagatagagaaccgctataaaattctaaataacagtctgaatccggcaatctcagaggacaacgatttcaataccactacaaacacatttatcgatagtattatggccgaagcaaatgcggacaacggtcgttttatgatggaactcggtaagtacctgcgcgtcggtttcttcccggatgttaaaaccaccatcaacttatcgggaccagaagcgtatgctgcggcctaccaggatctgctgatgtttaaagaaggaagcatgaatatacatctaattgaagcagacctgcgtaacttcgagatatctaaaaccaacatctcccaaagcaccgaacaggaaatggcctcactgtggagctttgacgatgcgcgcgcaaaagcccagtttgaagaatataaacgaaattactttgaaggtagcttg

SEQ ID NO: 62 - protein, 228 aa, Artificial Sequence
  Mutated sequence
LSEDNGVDFNKNTALDKNYLLNNKIPSNNVEEAGSKNYVHYIIQLQGNDISYEATCNLFSKNPKNSIIIQRNMNESAKSYFLSDDGESILELNKYRIPERLKNKEKVKVTFIGAGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEA

SEQ ID NO: 63 - DNA, 735 bp, Artificial Sequence
  Mutated sequence
atgggcagcagccatcatcatcatcatcacgaaaacctgtacttccagggcctgtccgaagacaatggagtggacttcaacaaaaataccgctctagacaaaaactatctgctgaacaataaaatcccgagcaacaacgtggaagaagcaggctcgaaaaattacgttcattatataattcaattacagggcaacgatattagctacgaagcgacgtgcaacctgttttctaaaaatccaaaaaacagtatcatcattcaaaggaatatgaacgagtcggcgaaatcatactttctgagtgatgacggcgaaagcatcctggaactgaataaatatcgaattcctgaacgtctgaaaaacaaggaaaaagtgaaagtgacattcatcggtgcgggtaaagatgaattcaacacttcagaatttgcccgcctgtcggtggatagcctttcaaatgagattagcagctttttagacacaattaaactggatattagcccgaaaaacgtggaagtgaacctgttgggcgcgaatatgttcagttatgattttaacgtcgaagaaacctacccaggaaagctactcctgtcgatcatggacaaaatcacctcaaccctgcctgacgtgaataaaaactccatcaccattggcgcgaatcagtatgaggtgcgtatcaacagtgagggccgcaaagaactgctagcacacagcggtaaatggattaataaagaagaagcc

SEQ ID NO: 64 - protein, 224 aa, Artificial Sequence
  Mutated sequence
GEDDNLDFSQNIVVDKEYLLEKISSLARSSERGYIHYIVQLQGNKISYEAACNLFAKTPYDSVLFQKNIEDSEIAYYYNPGDGEIQEIDKYKIPSIISDRPKIKLTFIGAGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEES

SEQ ID NO: 65 - DNA, 672 bp, Artificial Sequence
  Mutated sequence
ggtgaagatgacaaccttgatttctctcaaaatattgtggtcgacaaggagtatctgctggaaaaaatttccagcttagcgcgttcgagcgagcgcggctatattcactacatcgttcaactgcagggcaacaaaatcagttatgaagcggcgtgcaacctgtttgcgaagaccccgtatgacagtgtgctatttcaaaaaaacattgaagatagcgagatcgcgtactattacaatcctggcgatggtgaaattcaggaaattgacaagtataaaatcccgtcgattatctctgaccgtccaaagatcaaactgacgtttatcggtgcgggtaaagatgaattcaacaccgatatttttgcgggttttgacgtggatagcctgtcaacggaaattgaagcggcgattgatttagcaaaagaggacatctccccgaagagcattgaaattaatctgctgggcgcgaacatgttttcatacagcataaacgtggaggagacctatcctggtaaactgctgttgaaagtcaaagataaaattagcgaattaatgccgtctattagccaagactccatcattgtgtcggcgaatcagtacgaagttcgcattaacagtgaaggccgtcgcgagctgctagatcattctggtgaatggattaataaagaagaaagt

SEQ ID NO: 66 - DNA, 624 bp, Artificial Sequence
  Mutated sequence
catatgcgttactacttcgataccgatacagccatcgcttttaacggttataaaaccatcgacggtaaacacttttactttgatagcgattgtgtggtaaaaattggtgtattctcgacaagcaatggctttgaatattttgcgccggcaaacacctataataacaacattgaaggtcaagccattgtctaccagagtaaattcctgaccctaaatggtaaaaaatattacttcgacaacaacagcaaagcggttacaggctggcagaccatcgattcgaaaaaatattactttaataccaacaccgcagaagcggccaccggttggcaaaccatcgatggtaaaaaatactactttaacaccaacaccgcagaagcggccaccggctggcagaccatcgacggtaaaaaatattacttcaataccaacaccgcaattgccagcaccggttacacgatcatcaacggtaaacatttttattttaataccgatggtatcatgcaaattggcgtattcaaaggcccaaacggctttgaatattttgcgcctgcaaatacagatgccaacaacattgagggtcaggcaattttgtaccaaaacgaattcctgaccctaaatctcgag

SEQ ID NO: 67 - DNA, 2601 bp, Artificial Sequence
  Mutated sequence
catatggacccaattgaatttaacctggtgaccggttggcaaaccataaacggtaaaaaatattattttgacattaataccggcgcggcactgatcagttacaaaatcatcaacggtaaacacttttatttcaataacgatggtgtaatgcaactaggcgtgtttaaaggccctgatggttttgaatacttcgcgccggctaatacccagaacaataacattgaaggtcaagccattgtctatcagtcgaaattcttaaccctaaacggaaaaaaatattactttgacaatgacagcaaagcggtaaccggctggcgcatcatcaacaacgagaaatattactttaatccaaacaatgcaatcgccgcggtaggcctacaagtgatcgacaacaataagtattacttcaaccctgacaccgcaataataagcaaaggttggcaaaccgttaatggtagtcgttactacttcgataccgatacagccatcgcttttaacggttataaaaccatcgacggtaaacacttttactttgatagcgattgtgtggtaaaaattggtgtattctcgacaagcaatggctttgaatattttgcgccggcaaacacctataataacaacattgaaggtcaagccattgtctaccagagtaaattcctgaccctaaatggtaaaaaatattacttcgacaacaacagcaaagcggttacaggctggcagaccatcgattcgaaaaaatattactttaataccaacaccgcagaagcggccaccggttggcaaaccatcgatggtaaaaaatactactttaacaccaacaccgcagaagcggccaccggctggcagaccatcgacggtaaaaaatattacttcaataccaacaccgcaattgccagcaccggttacacgatcatcaacggtaaacatttttattttaataccgatggtatcatgcaaattggcgtattcaaaggcccaaacggctttgaatattttgcgcctgcaaatacagatgccaacaacattgagggtcaggcaattttgtaccaaaacgaattcctgaccctaaatggtaaaaaatactacttcggtagtgacagcaaagcggtcaccggttggcgcatcatcaacaacaagaaatattactttaatccgaacaatgccatcgcagcgatccatctctgcaccattaacaatgacaagtattactttagctacgacggcatcctgcagaacggctatatcaccatcgaacgtaataacttctacttcgatgccaataacgaatccaaaatggtgacgggcgtgtttaaaggcccaaatggttttgagtatttcgcgccggcaaacacccacaataacaacattgaaggtcaagccattgtttaccaaaacaaattcctgaccctaaatggaaaaaaatattactttgataacgacagcaaagcggtcaccggctggcagacaatcgacggtaaaaaatattactttaatcttaacaccgcagaagcggccaccggctggcaaaccatcgatggtaaaaaatattacttcaacttgaacaccgcagaagcggccaccggctggcagaccatcgatggtaaaaaatactactttaataccaacaccttcattgctagcaccggttatacttcgatcaacggtaaacatttttactttaataccgacggtatcatgcaaattggcgtattcaaaggtcctaacggctttgaatactttgcgccagcaaatacccacaacaataacattgaaggtcaggccattctgtaccaaaacaaattcctgaccctaaatggtaaaaaatattacttcggtagtgacagcaaagcggttacaggcctaaggaccatcgatggtaaaaaatattactttaacaccaacaccgcagtcgcggttaccggctggcagaccatcaatggtaaaaaatactactttaacaccaacacctctattgccagcaccggttacacgatcatctcgggtaaacatttctattttaataccgatggtatcatgcaaattggcgtatttaaaggtccggacggcttcgaatactttgcgcctgcaaacacggatgccaacaatattgagggtcaggcaattagatatcaaaaccgcttcctctacctgcatgacaatatttattactttggtaacaatagcaaagcggccaccggttgggtgaccatcgatggtaaccgttattacttcgagccaaatacggcaatgggtgctaacggttataaaaccatcgacaataaaaacttctactttcgcaatggtctgccgcaaattggcgtatttaaaggatctaacggcttcgaatactttgcgcctgccaatacagatgcaaacaacattgaaggtcaggccattagataccaaaatcgtttcctccatttacttggcaaaatttattactttggtaacaatagcaaagcggtcaccggttggcaaaccatcaacggtaaagtgtattactttatgccagataccgcaatggccgcggcaggtggcttgttcgagatcgacggtgttatttacttcttcggtgtcgatggcgtgaaagctccgctcgag

SEQ ID NO: 68 - DNA, 1548 bp, Artificial Sequence
  Mutated sequence
attaccggcttcgtaaccgtgggagacgataaatactactttaacccgatcaatggtggtgccgcaagcatcggcgagacgattatcgatgacaaaaactattatttcaaccagagcggcgtactgcaaacgggtgtgttttcgacggaggacggcttcaaatactttgctccggccaatactctggatgaaaacctcgaaggcgaagcgatcgattttaccggtaaactgatcatcgacgaaaacatctattattttgacgataattaccgtggcgcagtggaatggaaagaactggatggtgagatgcactatttctcaccggaaacgggtaaagcctttaaaggtctcaaccagattggtgactacaaatactatttcaattccgatggcgtcatgcagaaaggctttgttagtattaacgataataaacactattttgacgattctggtgtcatgaaagtgggttacaccgaaattgatggaaagcatttctacttcgcagaaaacggcgaaatgcagattggtgtgtttaacacggaagacggctttaaatacttcgcccaccataatgaagatttaggcaacgaagagggtgaagaaataagctattccggtattctgaatttcaacaataaaatctactactttgatgacagctttactgcagtggttggctggaaagatctggaggacggtagcaagtattatttcgatgaagatacggcggaagcgtacattggtctaagcctgattaacgacggtcaatattactttaatgatgatggcatcatgcaggtcggttttgtaaccattaacgacaaagtattctacttcagcgactctggcatcattgaatccggcgtgcagaacattgatgacaattatttctatattgatgacaacggtattgttcagatcggtgtgtttgataccagcgatggctacaaatatttcgcgccggccaataccgtgaacgacaatatctacggccaagcggtcgaatatagtggtctggttcgcgtcggtgaagatgtgtactattttggtgagacgtatactatcgagaccggctggatttacgatatggaaaacgaatcggacaaatattacttcaatccggaaaccaaaaaagcgtgcaaaggtatcaacctgatcgatgatattaaatattattttgacgagaagggaattatgcgtacaggtttgattagcttcgaaaataacaattactactttaacgagaatggtgaaatgcagtttggttatattaacattgaagataagatgttctactttggtgaagatggtgtaatgcaaatcggcgtgttcaatacgccggacggctttaaatactttgcgcatcagaacaccctagatgagaattttgagggcgagagcattaactataccggttggctggatttagacgaaaagcgctactatttcacggatgaatatatcgcggcgaccggtagcgttatcatcgatggtgaggagtactattttgaccctgatacggcacaactggtaatcagcgaactcgag

SEQ ID NO: 69 - DNA, 636 bp, Artificial Sequence
  Mutated sequence
gttcagatcggtgtgtttgataccagcgatggctacaaatatttcgcgccggccaataccgtgaacgacaatatctacggccaagcggtcgaatatagtggtctggttcgcgtcggtgaagatgtgtactattttggtgagacgtatactatcgagaccggctggatttacgatatggaaaacgaatcggacaaatattacttcaatccggaaaccaaaaaagcgtgcaaaggtatcaacctgatcgatgatattaaatattattttgacgagaagggaattatgcgtacaggtttgattagcttcgaaaataacaattactactttaacgagaatggtgaaatgcagtttggttatattaacattgaagataagatgttctactttggtgaagatggtgtaatgcaaatcggcgtgttcaatacgccggacggctttaaatactttgcgcatcagaacaccctagatgagaattttgagggcgagagcattaactataccggttggctggatttagacgaaaagcgctactatttcacggatgaatatatcgcggcgaccggtagcgttatcatcgatggtgaggagtactattttgaccctgatacggcacaactggtaatcagcgaactcgag

SEQ ID NO: 70 - DNA, 1521 bp, Clostridium difficile
atgtcaagtataagtccagtaagagttacaggcctttcaggaaattttgatatggaaggtataatagaagctagtatgataagagataaggaaaaagttaataaagcgaaacaagatcaacaaatagttaaatggaaacaagaaatatacagggatattataaaagagtcaaagaatctttatgacaagtatttaaatggagactctcctaatagtataacaaataaaaaagcatattctgctacaagaataactagttctgatgaaagtattatagtagcaaaaggctcagctggtgcagaaaaaataaattatcaatttgcagtttctcaaatggctgaaccagcaaaagtaactattaagttaaattcaagtgaccctattgttcaacagtttcctccaaatgctagtggagcaagttctttaaatataggtggtgtaaatataccaatatctgaacaagatactacaagtactattgtaagtaagataaactccctttgtgcagataatgatataagagcttcttatagtgagatgacaggtgaattgattatctcaagaaaacagactggttcatcatcagatattgatttaaaagtaattggaaatgatagtttagctggacaaattgccagtgataatggtattacatttacaactgatgctagtggaactaaatctgcagtagtatatggaaaaaatttagaagctgatgtaactgatgaccaaggaagagtaacacacataagtaaagaacagaattcatttaaaatagataacattgattataatgtaaattcaaaaggaagtgctaaactggtttctgttactgacactgaagaagctactaaaaatatgaaagcatttgtagatgattataatgcattgatggataaggtttatggattagttactactaaaaaatcaaaagattatccacctcttacagatgaacaaaaagatgatatgacaactgaagaaatagaaaagtgggaaaagaaggcaaaggaaggaatacttagaaatgatgatgaattaagagcttttgttgaagatattcagtctatgttttttggagatgcagatactattattgctttaagaaaactgggtattagtgagcatgagaattataacaaaaaaggacaaatatcatttaatgcagatactttttcgaaggctcttatagatgatagtgacaaggtatataaagctttagctggatattcttcaaattatgatgataagggtatgtttgaaaaattaaaaaaaattgtatttgaatattctggaagttcagcttctaaacttactaaaaaagcaggtatggaaaattcttcgtctgctagtcaaaatgtatattcaaaacaaattgcagagcaagaaagaaatataagtaggttagttgaaaaaatgaatgataaagagaaaagactttatgctaaatattcagctttagagtctttgttgaataaatattcttcacaaatgaactatttctcacaagcacaaggtaat

SEQ ID NO: 71 - protein, 507 aa, Clostridium difficile
MSSISPVRVTGLSGNFDMEGIIEASMIRDKEKVNKAKQDQQIVKWKQEIYRDIIKESKNLYDKYLNGDSPNSITNKKAYSATRITSSDESIIVAKGSAGAEKINYQFAVSQMAEPAKVTIKLNSSDPIVQQFPPNASGASSLNIGGVNIPISEQDTTSTIVSKINSLCADNDIRASYSEMTGELIISRKQTGSSSDIDLKVIGNDSLAGQIASDNGITFTTDASGTKSAVVYGKNLEADVTDDQGRVTHISKEQNSFKIDNIDYNVNSKGSAKLVSVTDTEEATKNMKAFVDDYNALMDKVYGLVTTKKSKDYPPLTDEQKDDMTTEEIEKWEKKAKEGILRNDDELRAFVEDIQSMFFGDADTIIALRKLGISEHENYNKKGQISFNADTFSKALIDDSDKVYKALAGYSSNYDDKGMFEKLKKIVFEYSGSSASKLTKKAGMENSSSASQNVYSKQIAEQERNISRLVEKMNDKEKRLYAKYSALESLLNKYSSQMNYFSQAQGN

SEQ ID NO: 72 - DNA, 870 bp, Clostridium difficile
atgagagttaatacaaatgtaagtgctttgatagcaaacaatcaaatgggaagaaacgtaaatggacaaagtaagtctatggagaagttatcttctggggttagaatcaagagagctgctgatgatgctgctggacttgcaatatctgagaaaatgagagctcaaataaaaggtttagaccaagcaggaagaaacgttcaagatggtatatctgttgtacaaacagcagaaggttcgttagaagaaactggaaatatactacaaagaatgagaactttatcattacaatctgcaaatgaaattaataatactgaagaaagagaaaagatagctgatgagttaacacaattaaaagatgagattgaaagaatatcaagttcaacagagtttaacggtaagaagctacttgatggaacttcttcaacaataagattacaagttggagcaagttatggaactaatgtttcaggtacaagtaataataacaatgagataaaaattcaattagtaaatactgcaagtataatggcttcagctggtataacaactgcttcaataggaagtatgaaggcaggtggaactacaggaacagatgcagctaaaactatggtatctagcttagatgcagctcttaagagcttaaactcatcaagagcaaaattaggagcacaacaaaacagactagaatcaactcaaaacaatttaaataatactttagagaatgttacagcagcagaatcaagaataagagatacagatgttgcttcagaaatggttaacttatctaaaatgaatatattagttcaagcatcacaatcaatgcttgctcaagctaatcaacaaccacaaggagttttacaattattagga

SEQ ID NO: 73 - protein, 290 aa, Clostridium difficile
MRVNTNVSALIANNQMGRNVNGQSKSMEKLSSGVRIKRAADDAAGLAISEKMRAQIKGLDQAGRNVQDGISVVQTAEGSLEETGNILQRMRTLSLQSANEINNTEEREKIADELTQLKDEIERISSSTEFNGKKLLDGTSSTIRLQVGASYGTNVSGTSNNNNEIKIQLVNTASIMASAGITTASIGSMKAGGTTGTDAAKTMVSSLDAALKSLNSSRAKLGAQQNRLESTQNNLNNTLENVTAAESRIRDTDVASEMVNLSKMNILVQASQSMLAQANQQPQGVLQLLG

SEQ ID NO: 74 - DNA, 960 bp, Clostridium difficile
atgagagtgagaaaaattttatctttaggaattgctggaatactagcaataggaatgttaacagggtgttcaatggaaggaccaagtaaatcagataataaaggtggttcagacaagaaagatttaactattggagtatctacaataactcttcaacatcaattttttatagatattgatgagggaataaaagaaaaagctaaagaattaggtgtgaaagttatagtaaatgacccagaccaagatgtagctaagcaaacatcagcaatagaagattttatacaacaaaatgtagatggaatgatagtacttggaactgataattcggctatagtaccagcagtagaaggagcatttgaaaaaatgccagtagttacagtagatgctgtattaaatactgaaaatattacaagttatgtaggaacagttagttatgatgctggtaaaaaattaggggaatacactaaaaaatacatagatgaaaagttaggtggaaagtcagaaatagcaatagtgacagatttaaaatctcaaatacaaatgcagagaatagatggatttaaagatgcattaaaaggttcagcaaatgttaagatattaaattcacaaccaggatatgacagagaagaatctcttaatacagtagaaaacttaattcaatctaatccagatgtagatataatatatgcaacagctgaaaatagtgtactaggagctaaagctgcacttgaatctgcaaaaaataaggatgttaagattgtaggatttgacttaactgaagaagcatcaagtggaataacagatggaactattcttgctatgattcaacaacaacctaaagagatgggacgtttagctgtagaagcagtagtaaaagctataaaaggggaaaaggtagaaaagaatataccagtaccagctttactttatgataaggaaaatataaaagactttaagaat

SEQ ID NO: 75 - protein, 320 aa, Clostridium difficile
MRVRKILSLGIAGILAIGMLTGCSMEGPSKSDNKGGSDKKDLTIGVSTITLQHQFFIDIDEGIKEKAKELGVKVIVNDPDQDVAKQTSAIEDFIQQNVDGMIVLGTDNSAIVPAVEGAFEKMPVVTVDAVLNTENITSYVGTVSYDAGKKLGEYTKKYIDEKLGGKSEIAIVTDLKSQIQMQRIDGFKDALKGSANVKILNSQPGYDREESLNTVENLIQSNPDVDIIYATAENSVLGAKAALESAKNKDVKIVGFDLTEEASSGITDGTILAMIQQQPKEMGRLAVEAVVKAIKGEKVEKNIPVPALLYDKENIKDFKN

SEQ ID NO: 76 - DNA, 801 bp, Clostridium difficile
atgaataaaaagggttttacactaattgaattgttagtagttatatctataataggcattttagttatagtagctattccagcattgtttagaaatatagaaaaaagtaaagcagttacatgtctttctaatagagaaaatataaagactcaaattgttattgcaatggctgaggaatcaagtaagggcaagaatgaagtcatgaaagaggtattagaaaacaaagatggtaagtactttgaaacagaaccaaagtgtaagtcaggtggaatatattcagcaacgtttgatgatggttatgatggaataactggaatagaaagcattgcaaaagtgtatgttacttgtacaaaacatccagatggtgttgaaatggctagggatatacatcaaagtatgaaagatttgattgcatcattttcacaagacccttctataataccaggagcctcaaagggtaatgatgattttagaaaatatttattagacaataaatataaaaatgggtggcctacaattccagatgaatttaaggcaaaatatggattaagtaaggatacactatatatacaaccatatgcatatagtcctactaaatctgatgctactgtagttgtatttgcaaataataagactgggggtaattggtatacttccctagtttacgattatgatgaaggtagatggtataaaggtaaaaatggtatttctgttgcaggtaggtcatgggatgttgacacagatagtgttaagtctgtaaaaacagagattcattctaaagagggatggggtcctttaaat

SEQ ID NO: 77 - protein, 267 aa, Clostridium difficile
MNKKGFTLIELLVVISIIGILVIVAIPALFRNIEKSKAVTCLSNRENIKTQIVIAMAEESSKGKNEVMKEVLENKDGKYFETEPKCKSGGIYSATFDDGYDGITGIESIAKVYVTCTKHPDGVEMARDIHQSMKDLIASFSQDPSIIPGASKGNDDFRKYLLDNKYKNGWPTIPDEFKAKYGLSKDTLYIQPYAYSPTKSDATVVVFANNKTGGNWYTSLVYDYDEGRWYKGKNGISVAGRSWDVDTDSVKSVKTEIHSKEGWGPLN

SEQ ID NO: 78 - DNA, 939 bp, Clostridium difficile
atgaggattagtaaaaaggtattggcgttaggtatttcagcattactattaagtgttagttttccaacatcaataaacgcactagataagattgaaaatattcaaggagtagataaatatgaaacagctgggcttatttcagataagcaagattttacaacagcagttcttatcaatgcagactctacaatggtagatggaattgctgcaagtggtcttgcaggagtaaataatgcagctattttattaactaataaggatgatataccagaagcaacgcttcaaagactgaatagagttactaagatatatgtaataggtggagaaaattctataagtaaagatgtagaaaaaatgttacttatgagaagaatgcaagttataagaattgatggtgtagatagagtagatacaagttataaaattgcaggcgaaatagaaaaaattaaaaacagtgataagatgtttttagtaaatggatttaaggatgaagctgatgcagtaagtgttgcatctgttgcttatagagatggagctcctataatattgacaaaagatataccttcagcagaagaagacacagacttagacccatggtttggagtttctcctgttccagtatatgctattggaggagagtctacattaagtgattacatagtgagcagatatagagcaactagaattggcggtgttgatagatatcaaactaataaaaatgttattgaaaagttctataatggagcaaaagagttctatataacaagtggagacgatttagtttatgctttagttgcatcaccacttgcaaaaaatgctcctgttgttttagtttcaaataaaagtgataagagtatattaagtggagctagtaaagtaacagcaataggtataagtgataagagtattatagagcaatgtttggatgctgtaaagaag

SEQ ID NO: 79 - protein, 313 aa, Clostridium difficile
MRISKKVLALGISALLLSVSFPTSINALDKIENIQGVDKYETAGLISDKQDFTTAVLINADSTMVDGIAASGLAGVNNAAILLTNKDDIPEATLQRLNRVTKIYVIGGENSISKDVEKMLLMRRMQVIRIDGVDRVDTSYKIAGEIEKIKNSDKMFLVNGFKDEADAVSVASVAYRDGAPIILTKDIPSAEEDTDLDPWFGVSPVPVYAIGGESTLSDYIVSRYRATRIGGVDRYQTNKNVIEKFYNGAKEFYITSGDDLVYALVASPLAKNAPVVLVSNKSDKSILSGASKVTAIGISDKSIIEQCLDAVKK

SEQ ID NO: 80 - DNA, 993 bp, Clostridium difficile
atgaaaaagtatatttctataatattattagtggtgttgactatggttgttttggtaggatgttcaccaggaaaagataaccctaaaaataaggagctatcagttgtcaaacaagtaaaagtagctgttccagatggactaccagcagtggcaatagctaaacttgcaaatgaaaatccagagattaaagaaggatatgaaacagtgtatagcattgaaaagacacctgaggcgatttccactagagtgatgaaaaaagatgcagatatagctatagttccttcaaacatggctgcaatagcgtataataaaacttcatcatataatattgttggaactgtaggaatgggttcactttatttggtgtcaacagaaaatataaaagattactctgatttagttggtaaagaagttggatgtactggaaaaggacttactccagacataactataaaaagtcttttgttacaaaaggatataaattattcagatataaaatttaattatgtaagttcagcaagtgaactggtaccattattggctactggtaaagttaaaacaggtattgttccagaacctgcacttagtgctttgatgtctaaaaatccagacataaaaattataaaaagtttaaatgactcatggaaggaagtaagtggttcaaaagacggttatcctcaatctactttaattgtaaagtctgaatttttaagagataataaagattttgttgattcttttgtaggtcaattatcaaatagtatagattgggcaaacaaaaatcctgaagaattaggtgcatattctgaaaaaataaaaatatctactgaatcaaagataataggaaaatctcttgaaagagctaatttgaaatatattccagttaaggacatgattaaagattataaaaattactatgagaaattagctaattttgatgataagacattaggaggcaaagtaccagatgaagcaatatactttgttgagaaa

SEQ ID NO: 81 - protein, 352 aa, Clostridium difficile
MKKYISIILLVVLTMVVLVGCSPGKDNPKNKELSVVKQVKVAVPDGLPAVAIAKLANENPEIKEGYETVYSIEKTPEAISTRVMKKDADIAIVPSNMAAIAYNKTSSYNIVGTVGMGSLYLVSTENIKDYSDLVGKEVGCTGKGLTPDITIKSLLLQKDINYSDIKFNYVSSASELVPLLATGKVKTGIVPEPALSALMSKNPDIKIIKSLNDSWKEVSGSKDGYPQSTLIVKSEFLRDNKDFVDSFVGQLSNSIDWANKNPEELGAYSTGTTCACCAGGAAAAGATAACEKIKISTESKIIGKSLERANLKYIPVKDMIKDYKNYYEKLANFDDKTLGGKVPDEAIYFVEK

SEQ ID NO: 82 - DNA, 1293 bp, Clostridium difficile
ttgttggggggagtgatagtagtgaaaaaagctatagcagctttaggaattggggcagtagcagtatctgttagctccataaatgcaagtgctcttgaaaagggaacagtaacagcaagtgccttgaatataagaagtggaccaagttctgattgcgataaggtagcaaaattatacaagggaaaaactgtagagattttagaaaagtctaatggatggtataaagtaagggtatcgagttctgttgttggatggggaagtgcaaaatacatatcaacaagtggttcgtctgaaggtacatcaagtcaaaataattcaacttcaagtgggacaactattagtggaaatggtaaagtaaatgtgagttctagactgaatgtaagaagtggtgcaggtactaactattcattagttggtaaagcaaataatggagatgtagtaaagttactagaacaaagcaatggatggtataaaataaaactatcaaatggagttactggatgggctagtagccaatatatctctaaaacatcagaggatgttggaacgaataattctagtaattcaaatagtactaataattctgataaaaaaccatctagcgaagaatcaattgaaggcaagaatggtaaggtaacatctgctgtgagtttaaatgtaagaagtggtcctgggacaagctattctataataggaaaattaaatggtggagatgttgttgaattaaaagctaaaagtaatggttggtataaggtaaagttatcgagtggaacaattggatgggtgagtgccagttatatttctgagactaatgaggatacaaaagaaaaaccaaattcatcatctaaccaaaattctcaatctaatagtaactcaaagccatcatttactggaaattcagataaatctacagcaaaaggttcaacaatcgtagattttgcatatactcttattggaataccatatcaatggggagcttcaggacctgataaatttgactgttctggatttacacagtatgtttttaaacattctgtaggcgtttctattcctagagtttctagagaacaggctaattttggaagtgcaatttctatggggaattatgcaccaggagatttagtttattttgacactgatggtgatggaacaactaatcatgtaggtatatatgtaggaaatagtaaatttatccattgtagtggtactcagactaatcctaataaggttaaagtggataatttaactagttcatattggtctaaagtattacttggtgcaagaagatttgtt

SEQ ID NO: 83 - protein, 431 aa, Clostridium difficile
MLGGVIVVKKAIAALGIGAVAVSVSSINASALEKGTVTASALNIRSGPSSDCDKVAKLYKGKTVEILEKSNGWYKVRVSSSVVGWGSAKYISTSGSSEGTSSQNNSTSSGTTISGNGKVNVSSRLNVRSGAGTNYSLVGKANNGDVVKLLEQSNGWYKIKLSNGVTGWASSQYISKTSEDVGTNNSSNSNSTNNSDKKPSSEESIEGKNGKVTSAVSLNVRSGPGTSYSIIGKLNGGDVVELKAKSNGWYKVKLSSGTIGWVSASYISETNEDTKEKPNSSSNQNSQSNSNSKPSFTGNSDKSTAKGSTIVDFAYTLIGIPYQWGASGPDKFDCSGFTQYVFKHSVGVSIPRVSREQANFGSAISMGNYAPGDLVYFDTDGDGTTNHVGIYVGNSKFIHCSGTQTNPNKVKVDNLTSSYWSKVLLGARRFV

SEQ ID NO: 84 - DNA, 801 bp, Clostridium difficile
atgaaaaaacttaaattaattattatgtttgccttggtatcagcactgttagttacaggatgttcatcaggaaataataaaaataaagaagaacaaaaagttataagagttgcaacatcaggaacatattacccttttgcttttaaagataaagataaacttaaagggtttgaagtagatttttgggatgaatttgctaaacgaactaattgtaaagttgaatgggtattaactgattttagtggattatttggattattagaagctgataaagcagatgctgtatctgctcaacttactgcaacacctgaaagagagaaaaaatatgctttttcagatgcttataattatagtggaacaaacattattgttagagaagatgatactagtataaaatcaatagatgatttagttggcaagaaagtaggtgtgggtactggagcagtagcaaatgaaatattaaaagaaaaatacccaaatgatgaaataaaaatagtaaattattcaagtgcgactcttaaagggaattatcaagacctagaaatgggaagattagatgcagtagttgcgcaggatgttgaggctttaatagctataaaagaacaaaaattaaatcttaaaatgatagaacctccaattcaatttggtgcctgttcttttgcgcttcaaaaaaatgaaaaaggtgaaaaatggacaaaagaaattaacgaagtaattgaagagatgtataaagatgggactttgactaaaatatctgaaaactggctaggaaaagacattactaaggagcctattaatgag

SEQ ID NO: 85 - protein, 267 aa, Clostridium difficile
MKKLKLIIMFALVSALLVTGCSSGNNKNKEEQKVIRVATSGTYYPFAFKDKDKLKGFEVDFWDEFAKRTNCKVEWVLTDFSGLFGLLEADKADAVSAQLTATPEREKKYAFSDAYNYSGTNIIVREDDTSIKSIDDLVGKKVGVGTGAVANEILKEKYPNDEIKIVNYSSATLKGNYQDLEMGRLDAVVAQDVEALIAIKEQKLNLKMIEPPIQFGACSFALQKNEKGEKWTKEINEVIEEMYKDGTLTKISENWLGKDITKEPINE

SEQ ID NO: 86 - DNA, 1617 bp, Clostridium difficile
gtgattataataaattatgaattaattgtaaaatacaatggagatatattgaggttagaagaagaattaggtgtatcagtagagatacttaattcatcatatgcaataataacatcaagtaatgaagaagatgtaaatatacttttaacttatccagaaattgaatttatagaaaagccttttatattacagactcaggatgtgcaaagtttttcaagtacaggaataacaggatttaaaaatagaactggtttaactggaaaaggaactataattggtataattgattcgggaatagattatactctacctgtgtttagagatagtgatggaaggtctaagatattatattattgggaccaatctattcaaggaaatccaccagaaggttttagagaaggaacattatatactaatgaagatataaataatgcaatagatggaagtatgtatatacctatttcaacaactagcttacatgggacacatgttgcaggtatttgtgcaactattgcaagtgatgccagaataatagtggttagagttggaaatatacagaccgatattttttcgagaagtacagagtttatgagggcaattaaatttattttagatagggcattagaattaagaatgcctgttacattaaatataagttatggaagtaatgaaggttcacatagaggaacatctttatttgaacaatatatagatgatatgtgtttattttggaaaaacaatatagttgtagcagctggaaataatgcagataaaggaggtcataaaaggattaggcttcaaaataatattacagaagaagttgagtttatagttggggaaggagagcgtatattaaacataaatatatggccagattttgttgatgattttagtgtacatttggtaaacccatcaaataatcaaacacaagcaatctctctaacttcaggtgagataaggaatactttgggtgaaactagaataactggttatttttaccctatagcaccgtattctctcacaagaagagttactctacaattaagttcaaatacacagataactcctgggttatggaaaattgtatttgaaccaatagatatagtaactggtaatgtaaatatatatttgccaacttctgaaggtctaaatagaaatactagatttctgattcctactcaagagcttactgtaacagttcctggaacagcaagtagagttataacagtaggtagttttaattcaagaacagatatagtatctatattttctggtgaaggagatacacaattaggtgtttttaaacctgatttattagctccaggtgaagatatagtatcttttttaccaggaggtacaagtggagcattaactggaactagcatggctacacctcatgttacaggggtttgttcattgtttatggaatggggaattgtaaatggaaatgatttatttttgtattcacagaaattaagggcattacttctaaagggagcaaggagattaagtaatcaatcttatccaaataattcatcaggatttggttttttaaatttatcagatatagatttgtacactctatctaatataaatcaagacttagaaacagaggat

SEQ ID NO: 87 - protein, 539 aa, Clostridium difficile
MIIINYELIVKYNGDILRLEEELGVSVEILNSSYAIITSSNEEDVNILLTYPEIEFIEKPFILQTQDVQSFSSTGITGFKNRTGLTGKGTIIGIIDSGIDYTLPVFRDSDGRSKILYYWDQSIQGNPPEGFREGTLYTNEDINNAIDGSMYIPISTTSLHGTHVAGICATIASDARIIVVRVGNIQTDIFSRSTEFMRAIKFILDRALELRMPVTLNISYGSNEGSHRGTSLFEQYIDDMCLFWKNNIVVAAGNNADKGGHKRIRLQNNITEEVEFIVGEGERILNINIWPDFVDDFSVHLVNPSNNQTQAISLTSGEIRNTLGETRITGYFYPIAPYSLTRRVTLQLSSNTQITPGLWKIVFEPIDIVTGNVNIYLPTSEGLNRNTRFLIPTQELTVTVPGTASRVITVGSFNSRTDIVSIFSGEGDTQLGVFKPDLLAPGEDIVSFLPGGTSGALTGTSMATPHVTGVCSLFMEWGIVNGNDLFLYSQKLRALLLKGARRLSNQSYPNNSSGFGFLNLSDIDLYTLSNINQDLETED

SEQ ID NO: 88 - DNA, 1776 bp, Clostridium difficile
ggatatagaagtattaataagtcatttaaagatgaggaaaatagttataagtttatagatggttataatatgcaaatacataatgacttagagaatgaaatttatataagtaaaaatgcaagtagacaatcaggaatactatcaggaatagatatagtccatactcctgaatttgaagaagaactagctgggttaggtatgagtcaaaggttttttaagataagtgattcattaggtgtactatctataaataatacagactatagtagtatacaacgagttttgcaacttccttcaatcataagaactgtatcgactacaaagatgacattacttggagaaattaatcgaggtacttttggaggtgtagttgcaacagaagaaatgggcgtaaatttctttaaaaataatcctaatattaatataacaggaagagggactctaatatcaattgcagatacaggaatagactatctacacccagattttatttatccagatggcacttcaaaaatagtatatttatgggaccaaacaaaagaaggaactcctcctgatggtttttatattgggacagaatatacacgagaagatataaatcgagctatcgcagaaaatgaccctagtctatctcaggatgaagttggtcaaggaactatgttgagtgggatatgtgcagggcttggaaatgtaaatagtgaatatgcaggtatagcagaagattctgagctaataataataaaactcggcaagatagatgatttttataatagtgcaatgttgtttgctgcatctcagtatgcatataaaaaagcttttgaacttggaagaccattagttataaatatgtctttaggtaccagtagcctagcaggtttaaccaataggagtaatagtgaaaaagcgttctttactagagggttatgtataacggcaggagcaggaaatgagggcaatacacagacacatacatctggaataataccatatgttggaggttctgttgaagttgaattagagttaaatgaagacgaggaagaattatcattagaactttggttaaatagaccagataaagctgatgtaataatagtatctcccactggtgaagaaagtaaaagtgttggaatttcaaattataataaagtaacaggtttatttgatttagaggggactgaatattctataacatatatatacccaacaactttttctggacagcaatttactaatgttactttaaagaatgcaaaaagaggtgtatggaagattcgattagtaggagtttatattataacaggaagatataacttataccttccaaatagagaacttttaaaaagtggaactagatttagagaggtagaccctttttacactataaattatcctgcgattcaagatgatttaataaccataggagcctacaatactattaatggtagtttatggcaaagttcatcaagagggccaactattgaagacaggttaaaaccagatatagtagcaccaggtgttaatataatagctgcttatcctgggaacacgtatgcaactataactggtacagcagcagcaagtgcacatgcagctggtgctgctgcaatgtattttcaatatacttttgttgacggtagatatccaaaccaagcatatgtgcaaaaaataaaaacttttatgcaagctggtgctagaaaagattcaaacacagtatatccaaatacaaattctggatatgggctcttggatgttagaggaatgtttgatgttttaaga

SEQ ID NO: 89 - protein, 592 aa, Clostridium difficile
GYRSINKSFKDEENSYKFIDGYNMQIHNDLENEIYISKNASRQSGILSGIDIVHTPEFEEELAGLGMSQRFFKISDSLGVLSINNTDYSSIQRVLQLPSIIRTVSTTKMTLLGEINRGTFGGVVATEEMGVNFFKNNPNINITGRGTLISIADTGIDYLHPDFIYPDGTSKIVYLWDQTKEGTPPDGFYIGTEYTREDINRAIAENDPSLSQDEVGQGTMLSGICAGLGNVNSEYAGIAEDSELIIIKLGKIDDFYNSAMLFAASQYAYKKAFELGRPLVINMSLGTSSLAGLTNRSNSEKAFFTRGLCITAGAGNEGNTQTHTSGIIPYVGGSVEVELELNEDEEELSLELWLNRPDKADVIIVSPTGEESKSVGISNYNKVTGLFDLEGTEYSITYIYPTTFSGQQFTNVTLKNAKRGVWKIRLVGVYIITGRYNLYLPNRELLKSGTRFREVDPFYTINYPAIQDDLITIGAYNTINGSLWQSSSRGPTIEDRLKPDIVAPGVNIIAAYPGNTYATITGTAAASAHAAGAAAMYFQYTFVDGRYPNQAYVQKIKTFMQAGARKDSNTVYPNTNSGYGLLDVRGMFDVLR

SEQ ID NO: 90 - DNA, 1089 bp, Clostridium difficile
atgaaattatctaagaagattcaagcattaatcttatttggtgtaatgggtacatctatattaacaggatgtagtagtaaaccaaaagaaaaagaagaagcaaaaactggaaaagatgattatacaataacagtaggttattataattgtgaccatatgactgcgggaccagtagcagaatcggcaggaatatataaagatttaggtcttaatgtaaaaactgttggaaatggtaaagttcctgaagctatggcagcaggaaaaatggatgcaggttacataggaactaaggggttagttggagcaatacctaagggttcgccaataacaatagcagctaacaaccatactggtggttctgaatatttaatagtttcaaaagatataaaagaacctaaagatttaataggtaaaaaaattgcaacagatatgagtgatttcttatggacaagtgattatggtccagaaacaggtctaccaactgacccatcaaaatatgaagttgtaaatatggattcagacaaagataaatatttagctcttaaaactgggaaaattcaagcttttacatcttgtgacccttggggttctgtagctgaaaatgacggtgcaggaaaaataatagcatctactcaatataaagaaaaagctaatggcaaagaatataactgttgttcattctcattaaacaaaaactttataaaagaacatccagatttagcaaaaaaattggttctagcacatacaaaagcaatagaatatatatatacaaatccagctgaagcagctaaaatatttgcaaaatattataatgtagaagaagaagttgcacttagaactatctataagaagactgttggagaaggtagaactcttacttggaaagttacaggtgaagaatataaaaataatttacaaatgtataaagatttaaaggctttagatgatatacctaaatatgaagatacgattgatacaagcttattggactcttgtggagctgatgattttgacaaatttataaaagaaaaagttaacccagagtttcctgaaggtatgagttatgaagactggaaagcaaaggtatta

SEQ ID NO: 91 - protein, 363 aa, Clostridium difficile
MKLSKKIQALILFGVMGTSILTGCSSKPKEKEEAKTGKDDYTITVGYYNCDHMTAGPVAESAGIYKDLGLNVKTVGNGKVPEAMAAGKMDAGYIGTKGLVGAIPKGSPITIAANNHTGGSEYLIVSKDIKEPKDLIGKKIATDMSDFLWTSDYGPETGLPTDPSKYEVVNMDSDKDKYLALKTGKIQAFTSCDPWGSVAENDGAGKIIASTQYKEKANGKEYNCCSFSLNKNFIKEHPDLAKKLVLAHTKAIEYIYTNPAEAAKIFAKYYNVEEEVALRTIYKKTVGEGRTLTWKVTGEEYKNNLQMYKDLKALDDIPKYEDTIDTSLLDSCGADDFDKFIKEKVNPEFPEGMSYEDWKAKVL

SEQ ID NO: 92 - DNA, 1272 bp, Clostridium difficile
atgattaaactaaaaaaggttctttctttagttatggtagggattctatcagtatcaattcttgcaggatgttcaaaaaaagaagattctaaaggcaaagagggtaaagaaaaattagttgtatggtctgcaccattaacagaccatgatgcagatgcatggaagccgatatttgaaaaatttgaaaaagaaaataactgtgaaattgaatttcagatagtaccatgggataactacgcagaaaaatatgcaacagcaataagtgcaggtgaaggtccagatataggatacatgtatgcagagatgtttcctcaatttatagaaatgggtgcggtagaagatttaacaccttatttagaaaaatcaggaacttcagataattatctatacttagatgatgcaaaaatgatgggtggtatttatggtttacctatagaagctgctaatccaggcgtattgtactacaataaagatatactagaaaaattaggagaaaaacctccaaaaacatgggatgattttaaaagaatctgtgaaaaagcaacaaaagatactgatggagatggaaaaatcgaccagtggggtcttgcacaaggttggggttctaaagtatttggaagcttaaactggaactggtatccgtatttatggcaagctggtggagatatatataatgatgatttaaaatcagttaaatttaataatgcagaaggcttgaaagctgcaaactttataaatgatatgaaaaagtatattccagaagatgctttatcaaaagatagtaatgaaatgattgaaagtgtatttggaccaggaaaagctgcatttactataatgctatcctctgctgctacaagtacttttgataaatcattcccggatttaaactggggatatgtaacatcattagaagataagacagttggaagttttgcttcagtagatgatttaacattaatgtcagcatgtaaaaataaagaacttggatttaaacttcttgagtatatgctaagcaaagaatcaatggaagctttccacaaagaaatacctagagctccagttgctaaaggtgaaaaataccaaggagacccaagatttgaagaaatggtgacaagagataaacatatgtatagaccattgacagttggacctcatggagtagagatatatgaatatttatggaaacaacttcaaatgatgatagctggagacataactccagaacaagcactaaatgaatctgcaaaatatgcaaatggattactagcacaa

SEQ ID NO: 93 - protein, 424 aa, Clostridium difficile
MIKLKKVLSLVMVGILSVSILAGCSKKEDSKGKEGKEKLVVWSAPLTDHDADAWKPIFEKFEKENNCEIEFQIVPWDNYAEKYATAISAGEGPDIGYMYAEMFPQFIEMGAVEDLTPYLEKSGTSDNYLYLDDAKMMGGIYGLPIEAANPGVLYYNKDILEKLGEKPPKTWDDFKRICEKATKDTDGDGKIDQWGLAQGWGSKVFGSLNWNWYPYLWQAGGDIYNDDLKSVKFNNAEGLKAANFINDMKKYIPEDALSKDSNEMIESVFGPGKAAFTIMLSSAATSTFDKSFPDLNWGYVTSLEDKTVGSFASVDDLTLMSACKNKELGFKLLEYMLSKESMEAFHKEIPRAPVAKGEKYQGDPRFEEMVTRDKHMYRPLTVGPHGVEIYEYLWKQLQMMIAGDITPEQALNESAKYANGLLAQ

SEQ ID NO: 94 - DNA, 1053 bp, Clostridium difficile
atgattaaaaaaatttctactatattatcgttagttttgttaatctctatttctagtacgataggagtatttgcagatgcaaatcccaaaagagagttgatagaagggagtataccagagatttcgacagaattaaataaaagagcatttaaggattctaaagaagtaattcttgtaaatgaagagtcaattgtagatagtataagtgcaacacctttagcatattcaaaaaatgctccaatagttgtaactaagagtaaaaatcttggtagagtaacaagaaattatctaaaagaactaggtccagagaaggttacgatagtaggtggtttaaaggcagtatctaaagatgctgaacgtaatatagaaaaaatgggaatgaaagtagaaagaataagagggaaagacagatatgatacatctttaaagatagctagagaaatgtatagaacagtaggatttgatgaagcatttttacttagctcaacaacaggattagagaacgccatatctgtatattcttatgccgctaaaagtggaatgccaataatatgggctaaagatgaagggtttgaggaacaaattgatttcttaaaaggcaagaatcttaaaaaaatatatgcattaggtgattcaaaagaatttattgcagagattgattctaacttaaaaaatatagaaggaataaagcaaataaataagtcaagtacaaatgttgatttaataaagaagttttatgatgaaaaagatataaagaaaatctatactgctagattagactttggtagtagatctgatgtaaacgaatatatttctttgggagtagtatcagcaaaagaaaatatgccaatactgatttgtagtgataacttaagtcgtgcacaagataaattcttgaaagatagcaatataaatgatgtagttgaagttgggtatacagtaggtgattatagtctatttaagagcatatttaatctaacattcttatcttgtatagtattaatactattattactattgattacatttagggcacttagatatgagtcgaaa

SEQ ID NO: 95 - protein, 351 aa, Clostridium difficile
MIKKISTILSLVLLISISSTIGVFADANPKRELIEGSIPEISTELNKRAFKDSKEVILVNEESIVDSISATPLAYSKNAPIVVTKSKNLGRVTRNYLKELGPEKVTIVGGLKAVSKDAERNIEKMGMKVERIRGKDRYDTSLKIAREMYRTVGFDEAFLLSSTTGLENAISVYSYAAKSGMPIIWAKDEGFEEQIDFLKGKNLKKIYALGDSKEFIAEIDSNLKNIEGIKQINKSSTNVDLIKKFYDEKDIKKIYTARLDFGSRSDVNEYISLGVVSAKENMPILICSDNLSRAQDKFLKDSNINDVVEVGYTVGDYSLFKSIFNLTFLSCIVLILLLLLITFRALRYESK

SEQ ID NO: 96 - DNA, 1641 bp, Clostridium difficile
ttaccgagtacacccgttcatgcagaaagtaagcaatactggacggaaagtgcagagcgagtcggtatcattgaaaaagtaatgaatgacggttctatcggttctacattcaatgagggcatgatgaaagttgagggcgaaactgcctattgtattgacatcaatactgactttaagaatggttacaagaccagagctgacgcaagctcacgcatgagtgccgaccagatttcagatgtggcgttatccttagagtatgtcaaacagtatggcgaagctcacaaggaattgaactacaaacaagtctatctgttggaacaatgtgttgtctggcagagattaagcgtacatcttggctggcaatgcgacaacgtgcgagcttcttatgatgaaattccaaaggcaacgcaggacgaagtttttgctggtgcaaaagcctttgtcaaagaaaataaaggacgctatgaatgtggcggttatatctactctggcgaggggcaggaattgggacaattctgggcgaagctgaatgttggaaatgcaaaactgcaaaaaacctccagtaataccagcattacagacggtaacgggaattactctatcgctggtgcaacctacggtgtcttttctgataaggactgcacaaaacagcttgccacccttacgactgataaaaacggaaatacagatgttatagaggtaaaagctggcacagtctatatcaaggaattatctgcaccagcaggatataaagtggataaaacaatctatccattgacaatcaaagctggcgaaacagcgaccttgaaagtatcagatacgccaaaagtaacagacactttagttgagcttttcaagattgacatggaaacacagaaagacaatccgcaggggaacgcttctctagcaggtgcggaatttacatggaaatattatgctggcttctacaataaagacaatcttcctgccgaagctactcgtacatgggttacaaagacaatcgctgaaacagacagcgacgggacaacccactacatcacaaaattagcggacgcatacaaggtatctggcgacagcttctatatgcaggacggaaaagccgttcttcctttaggaacattaaccgttgaggaaacgaaagctccaaacggctacttgttagacggtgcatatatgcaggctggcgacaagtccgaacagattaagggcttatatcttacacagattaccgaggacggcgaccttgccgtattgactggaagtaaccagttttctgtatcagataaggttatccgtggcggtgtgaaaattcagaaacgagatttagaaacgggtgacacaaagccacaaggaagtgccacattgaaagatactgcctttgacatcatttccttaaatgataatgcggtattggttgagggcaagctatacaagaaaaatgaagtcgtaaaaaccattcatacagaccttgagggtgtggcttctacttctgccgaccttttaccttatggaaaattccgtatcgttgagagtgaagctcccgacggatatttgacagacggtgcgaagccgattgactttgcaatcacagaaaacggaaaaatcgtggacttaaccgatgaagcccattctatctacaat

SEQ ID NO: 97 - protein, 547 aa, Clostridium difficile
LPSTPVHAESKQYWTESAERVGIIEKVMNDGSIGSTFNEGMMKVEGETAYCIDINTDFKNGYKTRADASSRMSADQISDVALSLEYVKQYGEAHKELNYKQVYLLEQCVVWQRLSVHLGWQCDNVRASYDEIPKATQDEVFAGAKAFVKENKGRYECGGYIYSGEGQELGQFWAKLNVGNAKLQKTSSNTSITDGNGNYSIAGATYGVFSDKDCTKQLATLTTDKNGNTDVIEVKAGTVYIKELSAPAGYKVDKTIYPLTIKAGETATLKVSDTPKVTDTLVELFKIDMETQKDNPQGNASLAGAEFTWKYYAGFYNKDNLPAEATRTWVTKTIAETDSDGTTHYITKLADAYKVSGDSFYMQDGKAVLPLGTLTVEETKAPNGYLLDGAYMQAGDKSEQIKGLYLTQITEDGDLAVLTGSNQFSVSDKVIRGGVKIQKRDLETGDTKPQGSATLKDTAFDIISLNDNAVLVEGKLYKKNEVVKTIHTDLEGVASTSADLLPYGKFRIVESEAPDGYLTDGAKPIDFAITENGKIVDLTDEAHSIYN

SEQ ID NO: 98 - DNA, 1248 bp, Clostridium difficile
gatgaagcccattctatctacaatcagattaagcgtggagatattgagggcgtgaaaatcggtgcaggcacacacaagcgtcttgctgatgttccttttaggatcacaagtaagacgactggggaaagtcatgttgtggtaactgatgataacgggcaattttccacttctgctgactgggcttctcacaagcacaataccaacgcaggaaagaccagcgaggacggtgtatggtttggagcttctgaaccagacgacagcaagggtgcattgccttacgatgcttacatcattgaagaattgaaatgtgaaagcaacaaaggctttgaacttatcccgccttttgaaatcgtagtatcaagaaataaccttgtgattgatttagggactttgactgatgaatacgaaaaagaaatctctatccataccacagcgaccagcaaagacggcgaaaagactatccttgcaggaaaagaggtaacaatcgttgatacagtcaaattggacggacttacaaaaggtacaaaataccagttaaaaggctggcagatgttaaaggaagaaaacgccgagctaatcattgacgggaaacgtgtggaaaacgactatacctttatcgctgatgaggaagaaatgaaagtggaaatttcctatacatttaatgcgtctgctttaggtggcaagaaccttgttacctttgaagaattgtatgatttaagcaatccagacgaacccgtgaaagttgcggaacacaaggacattgaggacgacgggcagacggtacttatcacagagcgtatcatcaaaattcatacaactgctaccgacaaggacggcaacaaagagcttgaagcaggaaaagacgttacaatcattgataccgtaaccttagagggcttagaagtcggaacacagtacaaacttgtgggctggcagatgttgaaagaagaaaatgcagagcttcttgtcaatggaaaacgtgtggaaagtgattacacctttatcgctgacagcgaaaatatgaaagtggaagttgcctttacttttgacgctacctcccttgacggcaaacagcttgtaacttttgaagaattgtacgacttaagcaatacagacgagccgaagaaagttactgaacataaggacattgaggacgagggacagacgattacctttaaggaaaaaccagaagttccagagaagcccgaacagccacagacaccagaaaagcctagcagacctagcgac

SEQ ID NO: 99 - protein, 416 aa, Clostridium difficile
DEAHSIYNQIKRGDIEGVKIGAGTHKRLADVPFRITSKTTGESHVVVTDDNGQFSTSADWASHKHNTNAGKTSEDGVWFGASEPDDSKGALPYDAYIIEELKCESNKGFELIPPFEIVVSRNNLVIDLGTLTDEYEKEISIHTTATSKDGEKTILAGKEVTIVDTVKLDGLTKGTKYQLKGWQMLKEENAELIIDGKRVENDYTFIADEEEMKVEISYTFNASALGGKNLVTFEELYDLSNPDEPVKVAEHKDIEDDGQTVLITERIIKIHTTATDKDGNKELEAGKDVTIIDTVTLEGLEVGTQYKLVGWQMLKEENAELLVNGKRVESDYTFIADSENMKVEVAFTFDATSLDGKQLVTFEELYDLSNTDEPKKVTEHKDIEDEGQTITFKEKPEVPEKPEQPQTPEKPSRPSD

SEQ ID NO: 100 - DNA, 1413 bp, Clostridium difficile
caaactgtggcaacaaatttaacagggcaagaaagatatgaaactgctgttaaaataagtcaagatggatggaaaaatgctgatgaggtagtaatcgtaaacgactcatctatagcagatgctctatctgcaacaccatttgcaaaagcaaaaaatgctccaatacttttaacaagtaaagataaattaaatgataagacgaaagcagaaatacaaagattaaaagctaaaaaagtatacttaataggtggaacttctgtattaagtacaaatatagaaaaagaaataaaagatttaaaaatatcttttgagagaatctctggagctgagagatatcaaacatccttagaattagcaaagaaattagatgctataagtgatgttaagaaaatagctgtagttaatggtgaaaaaggacttgcagatgctgtaagtgtaggagcaccagctgcacaaaacaatatgccagtaatacttgctgattctaaaaatggaacagcagttgcagacaaatttataaaggatgctggaataactcaatcttatgtagtaggtggagagagttcaatttctgaagctgttaaaaataaactaccaaatagtacaagactaggtggaacagatagaaatgatacaaatgcaaaagtaataaaagaattttataaaaagacagatttaaaaaatgcttatgtaactaaagatggtatgaataaacaagaccaacttatagatgcactagcagtaggtgtattaggtgctaaaaatcaatcaccagtagttttagttggaaagaacttatcagcttcacaaaaatctctagttaactctaagagttttgataagataactaaagttggtgggaatggtaatgagacagcatttaatgaaatgaagtcattacaagaagtaaaaacagttgaagccaaaacaatttctgaattaaaatcagctatagataaagctactgctaatgatgttataaacttcaaaccaactagtgaggttaaagaagcatttacaatacaaactgataaagcagtaacagtaaacttaaatggtacatatacaaagactgtgactatcaacatgcctaatggtgatgtaaataactatgcaaaagtggatgatgtagttatagatgatgtaaaagatggaacttttgttaactatggaaaaataactaacttaaaggttaatgataaaaatggagccaagatagaaaataattctaaaggtgagattggtagtttaacagtagcatctggagcaagtcaagtaaaagtgactaatggtggtaagataactacagttacaaataattctaaagggactactatagataataaaggtacaataagtagtgttaagggagataattctccaacaataagtggaaatagtccaagttctaac

SEQ ID NO: 101 - protein, 471 aa, Clostridium difficile
QTVATNLTGQERYETAVKISQDGWKNADEVVIVNDSSIADALSATPFAKAKNAPILLTSKDKLNDKTKAEIQRLKAKKVYLIGGTSVLSTNIEKEIKDLKISFERISGAERYQTSLELAKKLDAISDVKKIAVVNGEKGLADAVSVGAPAAQNNMPVILADSKNGTAVADKFIKDAGITQSYVVGGESSISEAVKNKLPNSTRLGGTDRNDTNAKVIKEFYKKTDLKNAYVTKDGMNKQDQLIDALAVGVLGAKNQSPVVLVGKNLSASQKSLVNSKSFDKITKVGGNGNETAFNEMKSLQEVKTVEAKTISELKSAIDKATANDVINFKPTSEVKEAFTIQTDKAVTVNLNGTYTKTVTINMPNGDVNNYAKVDDVVIDDVKDGTFVNYGKITNLKVNDKNGAKIENNSKGEIGSLTVASGASQVKVTNGGKITTVTNNSKGTTIDNKGTISSVKGDNSPTISGNSPSSN

SEQ ID NO: 102 - DNA, 3306 bp, Clostridium difficile
aaggtaggtcaaataaaatttagtgcaacagataaacaaataaaaatggcatcaggagataagacagtagatccatcagataacacatatatactaaaattaacaaatgggacagtaaaagatggagatgtaaaagctaatgttaaagtagcaggattaccatcaggactagattatacagcagtaggaaatagatcagcaaatacaataacaattacagtatcaggaacagcaagccaatcaatacaaaatgatttaaataatgtaagtgtgctagttaaagcaggagcagtatctggaacaggagctacagattcaattgcaaatacaacatttgaaattaaaaaatatgtggcgccagcaataggtcaattaacttttgatgcaacagataaacaaataaaaatggcatcaggagataagacagtagatccatcagatgacacatatgtactaacattaacaaaaggaacagcaaaagatggagatgtaaaggctaatgttgaagtaacaggattaccatcagggttagattatacagcagaaggagattcatcaacaaatacaataacaataacagtatcaagaacagcaagccaagcagtacaaactgatttagataatgtaagtgtgttagttaaagcaggagcagtatctgaaacaactgccacagattcagcagcaaatgcaacatttgaagttaaaaaatatgtggcagcgccagcagtaggtcaattaacttttgatgcaacagataaacaaataaaaatggcatcaggagataagacagtagacccatcagatgacacatatgtactaacattaacaaaaggaacagcaaaagatggagatataaaggctaatgttgaagtaacaggattaccatcagggttagattatacagcagaaggagattcatcagcaaatacaataacaataacagtatcaggaacagcaagccaagcagtacaaactgatttagataatgtaagtgtgctagttaaagcaggagcagtatctgaaacaactgctacagattcagcagcaaatgcaacatttgaagttaaaaaatatgtggcagcgccagcagtaggtcaattaacttttgatgcaacagataaacaaataaaaatggcatcaggagataagacagtagatccatcagatgacacatatgtactaacattaacaaaaggaacagcaaaagatggagatgtaaaggctaatgttgaagtaacaggattaccatcagggttagattatacagcagaaggagattcatcagcaaatacaataacaataacagtatcaggaacagcaagccaagcagtacaaactgatttagataatgtaagtgtgttagttaaagcaggagcagtatctgaaacaactgctacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaataggattaccatcagggttagattatacagcagaaggagattcatcagcaaatacaataacaataacagtatcaggaacagcaagccaagcagtacaaactgatttagataatgtaagtgtgctagttaaagcaggagcagtatctgaaacaactgctacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaataggattaccatcagggttagattatacagcagaaggagattcatcagcaaatacaataacaataacagtatcaggaacagcaagccaagcagtacaaactgatttagataatataagtgtgttagttaaagcaggagcagtatctgaaacaactgctacagattcagcagcaaatgcaacatttgaagttaaaaaacatgcgtcagatccaatatcaacaataggaaaaatatcttctgggctatcaagtttatttaatatattaaaa

SEQ ID NO: 103 - protein, 1102 aa, Clostridium difficile
KVGQIKFSATDKQIKMASGDKTVDPSDNTYILKLTNGTVKDGDVKANVKVAGLPSGLDYTAVGNRSANTITITVSGTASQSIQNDLNNVSVLVKAGAVSGTGATDSIANTTFEIKKYVAPAIGQLTFDATDKQIKMASGDKTVDPSDDTYVLTLTKGTAKDGDVKANVEVTGLPSGLDYTAEGDSSTNTITITVSRTASQAVQTDLDNVSVLVKAGAVSETTATDSAANATFEVKKYVAAPAVGQLTFDATDKQIKMASGDKTVDPSDDTYVLTLTKGTAKDGDIKANVEVTGLPSGLDYTAEGDSSANTITITVSGTASQAVQTDLDNVSVLVKAGAVSETTATDSAANATFEVKKYVAAPAVGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVIGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVIGLPSGLDYTAEGDSSANTITITVSGTASQAVQTDLDNISVLVKAGAVSETTATDSAANATFEVKKHASDPISTIGKISSGLSSLFNILK

SEQ ID NO: 104 - DNA, 2037 bp, Clostridium difficile
atgttaagtaaggagattaatatgagaagaaatacaaaattattaacaacaggaattctttcaatggcaatcgtcacacctacaatggcatttgctactgaatctaatgctatggaaaataacgctgatttaaatataaacttagagaaaaaaagtatcgttttaggtagtacctcaaaagtcagtgttaagtttaaagaaaaaccagatgcagatagcattacattaaagtataaatgctatgatatgccattggatacaactttaaactacaatcaatcaactgagtcatatgaaggaactatcaattataataaagacccagaatatctaaatgtttgggaactacaagggataacaataaacagcaaaaataatcctaaaactttaaacaaacaagaactagaaaagatgggattaaatttaaaagactataatgtaacacaggaatgtataattgaagatataacttctagaaaagatgtaaataaatatttaagaaaaacttctgcacctattacagaacttacaggaagtgatagatacgaaacagcagttaaaataagtaaagaaggctggaaaaatggttcagataaggtagttataataaatggggatgtaagtatagatggcattatatcaactccactagcaactacatataatgctccaatacttttggttgaaaaaaacaatgtacctaatagtgtaaaatcagaattaaagcgtttaaatcctagagatgtaattataattggagatgagaatgctatttctaaaactactgctaatcaaattaaatcgactgtaaatgctagtcaaacacgtctaaagggctctaatagatatgagacatctttattgatagcaaaggaaatagataaaaatcatgatgtggaaaaagtatacataacaaatgctaatggcggagaagtggatgcacttactatagcagcaaaagcaggtcaagacaagcaaccaattatattaactgataaaaatagtattacagacaatacatataaatggttaaagagtgaggatttacaaaatgcttattttataggtggccctcaaatgatatcaacaaatgttataaataaggtaaatgatataactaaagataatgttactaataatagagtatatggagcagatagacacgaaacaaatgcaaacgtaataaaaaaattctatacagatgatgagttagaggctgttttagtagctaaatcagatgtacttgttgatgctttagcagcaggtccattggctgcgaacttaaaatctccaatacttataacaccaaagacatatgtatctgcataccataaagaaaacttagaagctaaatcggcaaataaggtatataaaataggtggaggattgacttctaaggtaatgagctctatagcatcatcattatctaaacacaatacgactccaacagaaccaggaaatagtgggggcaagacagttatgattgacccaggacatggtggttcggacactggaacaacaggtaaaccattagggggtattagagaaaaagactatacattaaatacttcacttgcgacaactgaatatttacgttcaaagggattcaatgtaataatgacaagagacacagataagactttatctcttggaaatagaactgctttatctaactctttgagaccagatttatttacgagtatacactataatgcatctgatacaactgggaatggtgtagaagtattttataagcttaaagataaagatggaggaactactaagactgtagctacaaatatattaaatagaattttagagaaatttaatctaaaaaatagaggtgcaaaaacaagaacactatcaactgaccctacaaaagattatttatatgttttaagaaataatgatatgccagctgtacttgtagaatgtgcatttttggataatgagaaagatatgagtttacttaatacatcaaataaagtaaaagaaatgggtacacaaataggtaaaggcatagaagattcattaaaa

SEQ ID NO: 105 - protein, 679 aa, Clostridium difficile
MLSKEINMRRNTKLLTTGILSMAIVTPTMAFATESNAMENNADLNINLEKKSIVLGSTSKVSVKFKEKPDADSITLKYKCYDMPLDTTLNYNQSTESYEGTINYNKDPEYLNVWELQGITINSKNNPKTLNKQELEKMGLNLKDYNVTQECIIEDITSRKDVNKYLRKTSAPITELTGSDRYETAVKISKEGWKNGSDKVVIINGDVSIDGIISTPLATTYNAPILLVEKNNVPNSVKSELKRLNPRDVIIIGDENAISKTTANQIKSTVNASQTRLKGSNRYETSLLIAKEIDKNHDVEKVYITNANGGEVDALTIAAKAGQDKQPIILTDKNSITDNTYKWLKSEDLQNAYFIGGPQMISTNVINKVNDITKDNVTNNRVYGADRHETNANVIKKFYTDDELEAVLVAKSDVLVDALAAGPLAANLKSPILITPKTYVSAYHKENLEAKSANKVYKIGGGLTSKVMSSIASSLSKHNTTPTEPGNSGGKTVMIDPGHGGSDTGTTGKPLGGIREKDYTLNTSLATTEYLRSKGFNVIMTRDTDKTLSLGNRTALSNSLRPDLFTSIHYNASDTTGNGVEVFYKLKDKDGGTTKTVATNILNRILEKFNLKNRGAKTRTLSTDPTKDYLYVLRNNDMPAVLVECAFLDNEKDMSLLNTSNKVKEMGTQIGKGIEDSLK

SEQ ID NO: 106 - DNA, 1713 bp, Clostridium difficile
atgaagagaataaaagtcttaacagtcgttttagctataacttttatggtagctggttgtagtaatactaaaacaaaacaaagtagtagtgattcaagtttacaaagtcaaagttcgatagatgctaagtatataaacttaacaatggtaactccaaaaactataaatcctataactaatactgataagtctgttggttatataatgaatttagtttatgatagtttatttactatagatgagaactacaatgtaattcctcaattagttaaggagtataatatagctcaggatggaatgagtatagatataaagctaaaagatgcaaagtggcatgatggaaaaaatgttacttcaaatgatgtaaactatactattggtttaattcaaaaaagtgcagatagtccatataatgaatttactaaaaatatagcttctgtgaatattaaatcagataaagattttacaataaaatttaaagctagatatgctttttcaattgatagtttaatttttccaattgtatctcaaaatcatttagattcaaaagatgtaaatgacaagaataataatatgataggaaatgggaaatataaaatagaatcatatacagaaagagaaggaatggttttatctgtaaacaaagattactatgaagaagttccaaaaaccatgaagaacataaaagtaggtatggtgcctaatgaagatgcaaggacatctatggttatggctcttgatagtgatataaccaatgttacattaaatgatttaagtaagtttcaagaaaaagagtttaatataacaaaatatcaaggaagagattatgagtgtgtattatttaattataataatccttttttcaaagatgttaattttagaaaagcaattgcacactctatagataaagatagaattattagtgaaggttatatggatgatgctactccagttaattttccacttaattcaaaatcaaaatactataatagtgaaatgaaggatttagagtttaataaagataaggcgatagagtgtcttgctaaggtagaatatgcaaatgtaaactcagtaaatcaaaatgacaataaagtaaaaaatcagaaaaaatcagctaaaaagaactcaaagaagcttacgccagaagaagaagcaaaagctaaaaaagcagaagaagatagaatcaaaaaagaagctgaagagaaaaaaaatagagaaaaagaggaagtaaagaaaagtctttctgaaatgaacttaaagataatagtaaacagagataatagtgagagaataaaaactgcaaacataataaatgaaaacttaaaagctataggaataaatagtacagtaaatcagctgtcagataaggatatggaaaatgctcttaattctaaaaattatgatttagcattagttggatggaaactatcaattataccagatgcaagtagtattatagcgagtagtggatatactgatgataagttaaatggatatatgtctgcacttacaagttctacgtctgaaattgaaacaaaaaaagcatacaaagatgtacagacatatataaaagataatgcaacatttataagtttagctgtgagaaacaactatattgtaagtaatagtagattaaaaggtaaaattactccaaatgattttgatgtatatgagggaatatctaatttagatataaaatcgaatgaatcaaat

SEQ ID NO: 107 - protein, 571 aa, Clostridium difficile
MKRIKVLTVVLAITFMVAGCSNTKTKQSSSDSSLQSQSSIDAKYINLTMVTPKTINPITNTDKSVGYIMNLVYDSLFTIDENYNVIPQLVKEYNIAQDGMSIDIKLKDAKWHDGKNVTSNDVNYTIGLIQKSADSPYNEFTKNIASVNIKSDKDFTIKFKARYAFSIDSLIFPIVSQNHLDSKDVNDKNNNMIGNGKYKIESYTEREGMVLSVNKDYYEEVPKTMKNIKVGMVPNEDARTSMVMALDSDITNVTLNDLSKFQEKEFNITKYQGRDYECVLFNYNNPFFKDVNFRKAIAHSIDKDRIISEGYMDDATPVNFPLNSKSKYYNSEMKDLEFNKDKAIECLAKVEYANVNSVNQNDNKVKNQKKSAKKNSKKLTPEEEAKAKKAEEDRIKKEAEEKKNREKEEVKKSLSEMNLKIIVNRDNSERIKTANIINENLKAIGINSTVNQLSDKDMENALNSKNYDLALVGWKLSIIPDASSIIASSGYTDDKLNGYMSALTSSTSEIETKKAYKDVQTYIKDNATFISLAVRNNYIVSNSRLKGKITPNDFDVYEGISNLDIKSNESN

SEQ ID NO: 108 - DNA, 1368 bp, Clostridium difficile
gtgaaattaaagaaattattatcactagggttagtgtcaatgtttgttgctggttttcctatatcagctaatgcacttgaaacaatttatactattcaaggaaaagataaatacgaaacggctgctcttatagctgatgaacaaaattatactacagctatattaattaatgcagacagcacaatggctgatggattaagtgcgagtggacttgcaggagcaacaaatgcaccaatttttttaactaagaaaaataacatacctaatgcaactcttaaaagagtagagaaagctaaaaaggtatacataataggtggagaaagttctattgataaagcaacagaaactcttctaaaagataaaggaatagaggctaaaagacttcaaggtagtgatagaattaagacaagctataatgttgcaaaagaaataaactcaattaacaaagtaaataaagttatattgactaatgcttttaaaggagagcctgatgcaatgagtgctgcacctgtagcagttagagataaagcagctatagtattaactgatggaaaaagtgttccatttaatacaactggtgtagaaagttatgtaataggtggtacttcatcaatgagtgacaaactagttaatgatactaattcaactagattaggtggagtagatagatatgatactaataaaaaaatagtaaataagttctataatggcgcaaaagaattttatatagctagtggtactgatttagtttatgctttagttgcttcaccaatggctaaaaataatcctattgtactagttgatattggaagtaataaagatatacttaaaaatgctgcaaaagtgactgggataggaaatctaagtgataaaattatgctagagtgtgaaaataccatcaataatattagtcttccatcttcaaataaaaatataatatgtggattaaagattgattttgattcaaatcacataatttggcaagataaaggaagttatcttgaatgttatgatgataaccttgaatattatactgaaaaatataaagacccaacagttcctataaatatagaaaatacaagtacgcaaaatttagatgtaacaaaattaaaagtttatggagaagctaattcaacattatatatggggcaatacgctaaaataaaaatggattttaatagttttggtgtattaaagccaggagaaaaatgtactatttatttagatataatttcattagatccatcaagaagcatgacattaacattttcttatgtaggtgataaagaaaattataaatatgaacaaggattggtaagtagaatattattttataacccagatggagaagatttttttgaatataaa

SEQ ID NO: 109 - protein, 456 aa, Clostridium difficile
MKLKKLLSLGLVSMFVAGFPISANALETIYTIQGKDKYETAALIADEQNYTTAILINADSTMADGLSASGLAGATNAPIFLTKKNNIPNATLKRVEKAKKVYIIGGESSIDKATETLLKDKGIEAKRLQGSDRIKTSYNVAKEINSINKVNKVILTNAFKGEPDAMSAAPVAVRDKAAIVLTDGKSVPFNTTGVESYVIGGTSSMSDKLVNDTNSTRLGGVDRYDTNKKIVNKFYNGAKEFYIASGTDLVYALVASPMAKNNPIVLVDIGSNKDILKNAAKVTGIGNLSDKIMLECENTINNISLPSSNKNIICGLKIDFDSNHIIWQDKGSYLECYDDNLEYYTEKYKDPTVPINIENTSTQNLDVTKLKVYGEANSTLYMGQYAKIKMDFNSFGVLKPGEKCTIYLDIISLDPSRSMTLTFSYVGDKENYKYEQGLVSRILFYNPDGEDFFEYK

SEQ ID NO: 110 - DNA, 1347 bp, Clostridium difficile
tcagaattaggagagaatagtcagattcaaagtggttcaactaattcatcaactggagaggagaaggaaagcgacaataaaaagccagaacagactccagagaaagataaggcaacagataataaaaaaccagaacagaccccagaggaagaaaaaccaacagataataaaaaaccagaacagaccccagaagaagataagtcaacagataataaaaagccagagcaaactccagaaggagaaaagccaatagataataaaaagccagagcagataccagaagaagataagtcaacagataataaaaagtcagaacaagctttagaagatgaaaaaccactagacaataaaaatacagaaaaaactccagaggaagataatctattagaagatgaaaatttattgaaagttttagaagaagaacttaatgaagaaaatgaagactatggatttgttgtaaaaattaataacaatacaatagaaacggaatcaatgaaaaaaatatcatttaatttaacttatactccaacatcaaaaggaatacaagcaggagattcaataacttttaaggtgccagatgtattcaataaagttaatttagattatacaagtgaatgctttgataaaacagaaagtaatggagagtatacacttacatttagagaattacctaatggccaaagtgtaatgcaaggtaaaataggtttggaagcatatgttaaaaaggttgatgaagatactaatgcaaaaatacatattgaaactactggaaaaatagaaagtggaagtggagatatagatgtagaaataaaacctggagataaaacggatgttccagatgctaaaggaacacttaaaaagcttgttgaaggaaaaaaatcaactactgtatttatgccagttaaaaataaagatataaattacagtatacaagtaaatgaaaagcaggaagagttaaaagatattattttgtatgatgagcttcctgaaggattgacattgataaatggttctgtaagtgtagtaacaagtgatggaaaagaagttagtgattttaatattgaacagagtaaaaattctatttcagttaattttggaaatatagataaatcgtatactgttaagtataaggctagaatcagtgacaaaaatgcaaaacatggtaataaatataagaatgtagctaggattgaatctgatggtaagaagatacaagaagatgatgctactgtaagtatatttgatagaggagatgattatcttcttactaaaggacattcaggagcaacaaatattactcaagttggtcaagtaataaactatcagatttcaataaatgatgataaa

SEQ ID NO: 111 - protein, 449 aa, Clostridium difficile
SELGENSQIQSGSTNSSTGEEKESDNKKPEQTPEKDKATDNKKPEQTPEEEKPTDNKKPEQTPEEDKSTDNKKPEQTPEGEKPIDNKKPEQIPEEDKSTDNKKSEQALEDEKPLDNKNTEKTPEEDNLLEDENLLKVLEEELNEENEDYGFVVKINNNTIETESMKKISFNLTYTPTSKGIQAGDSITFKVPDVFNKVNLDYTSECFDKTESNGEYTLTFRELPNGQSVMQGKIGLEAYVKKVDEDTNAKIHIETTGKIESGSGDIDVEIKPGDKTDVPDAKGTLKKLVEGKKSTTVFMPVKNKDINYSIQVNEKQEELKDIILYDELPEGLTLINGSVSVVTSDGKEVSDFNIEQSKNSISVNFGNIDKSYTVKYKARISDKNAKHGNKYKNVARIESDGKKIQEDDATVSIFDRGDDYLLTKGHSGATNITQVGQVINYQISINDDK

SEQ ID NO: 112 - DNA, 1374 bp, Clostridium difficile
tcaccaataagtaatgttgttataacagataatataccagaaggcatgagattaactacttcaggagaagctgggcatgattttagagttgtagaaattccaatgaatgggagctggactccttggagtaaagaaaaaattgccaataatatttcatataaagtagaagaaaaaagaaatgaaagtgggcaagtagataaagttataactggatttacaattaatctcagtaaagaagaagtggaatcaaagttttttatagcttatacattaaaggtaattagtattgaagatagctatataaatagagctgttcttgatgcaaataatagtgaaattgataaaaatgatgagataaactttaagaaaaattctggattaataagcgcaaaaaaagaagttgataaaaaagttttaaacagtagtgataaccagattgttaaatacaaaatcaatatgtcaacttatggagtttatgatgcaggacaagtaaatcttttagatgaagtaaactcagttctagaaatatctaatataaaatattctgataatcttgaacttaaaaaagaagctggagatggaaaaaatacaataagattagtaaataaatacgaatttaaacagataaaagaaggggaacctgtgcaaagttgggttacatttgatgcaaacttcacaaatgtaaaagttggggagactatacgaaatgtggctcagattaatggttcaagtcctccaggagtagagactactaagcaaggttatgcttttgaagctaaaaaagtggatgctttagataaaaatgtactttcaggtgctaagttcaatttagaagatgcatttggaaatatagtagttaaggatttagtcagtgatgaagatggtataattcaatctagtgtaaaaaacccaggaacatattatttagtggagataatggctccacgtggatatgaaaaactgaaggataaaattaaggttgaaattggtaataaagatattggtagaatagtggatattggaaatatagaaaacataagacaagaaaatccaccagtaaatccaccagcaccaccaaatacagatgaaccaatagtaaatccaccagtaccaccaagcacagataaaccaaggaaaccatcaagttcatctgatacagaggatactatagttataaatccaccagtaccaccatcagaagatataataaatccgccaataccagaggtattgaatcctccagtaccaccatcagaagagatgatagaaactcctgttaaacagattattccaataccagaagtagtaaagccatcagtgtcagaagaaaaaaataataaagttaaagatgatactttggtaaatccaccagta

SEQ ID NO: 113 - protein, 458 aa, Clostridium difficile
SPISNVVITDNIPEGMRLTTSGEAGHDFRVVEIPMNGSWTPWSKEKIANNISYKVEEKRNESGQVDKVITGFTINLSKEEVESKFFIAYTLKVISIEDSYINRAVLDANNSEIDKNDEINFKKNSGLISAKKEVDKKVLNSSDNQIVKYKINMSTYGVYDAGQVNLLDEVNSVLEISNIKYSDNLELKKEAGDGKNTIRLVNKYEFKQIKEGEPVQSWVTFDANFTNVKVGETIRNVAQINGSSPPGVETTKQGYAFEAKKVDALDKNVLSGAKFNLEDAFGNIVVKDLVSDEDGIIQSSVKNPGTYYLVEIMAPRGYEKLKDKIKVEIGNKDIGRIVDIGNIENIRQENPPVNPPAPPNTDEPIVNPPVPPSTDKPRKPSSSSDTEDTIVINPPVPPSEDIINPPIPEVLNPPVPPSEEMIETPVKQIIPIPEVVKPSVSEEKNNKVKDDTLVNPPV

SEQ ID NO: 114 - DNA, 3570 bp, Clostridium difficile
atgcaacaaaaatgtaaaaagaaagcactatcaatgattttaagtatctcaatgggacttggatcagtagcatcatttaatgcgtcaaatactttcgcagatactatagaagaaagtactaatgcaggaaatgcagaaggagatactaatgcaggaaatgcaggaggggatgctaatgcaggaaatgcaggaggggatgctaatgcaggaaatgcaggaggggatgctaatgcaggaaatgcaggaggggatgctaatgcaggaaatgcagaagaagattctaatgcaggaaatgcagaaggagatgctaatgcaggaaatgcagaagaagatgctaatgcaggaaatgcagaagaagattctaatgcaggaaatgcagaagaagatatgaatgcattagttgtggaagaagccactgcagaagatcctacatctgtaggagactttaaaattagtggtggagaaataaatgtcgattttaaatttgcaagtggcgttttaactattcttagtggaaaacaaatgacaattcaaaataataatccaaatactccaacaacacataggattgttatacctaaagatgtaaaagctgaattaatatttgatggagtaaatattaaaactgcatctaatagcccatttactttaacaccagataaagatggtggtgcatatgcacatgttatattacaagatggtagtgaaaacaagctagagtcaggtgatgtatattatccaggtatgagagcaggaaaaggtactactctaactattgatgattctgttgtaaatagagatattgaaggagagtttatagttcctgagggtggaaaaattcctagagatgtaactctagaaaatggagacaagttaaaaaaaggagatcgccttacactactagatagtaataatagaggaagtttaaaagttgttggaaattattattctgcaggtattggcggtggaaatactgaaagtggaggaaatattattattaatggtggtgctataactgctataggtcaagaatcgagtcgtaatacaggatatggagctggaataggtggaggcggtaatggtagtggtggagatatcacaatcaatggtggtactataactgctaaaggtgcataccatggagctggaataggtggaggatactatacaacaacaaagaatgcattaagtccctcagtagtagatcctagcacaggttctggttatagtggaaatattacaattaatggtggactttcctattcatatggaggtgcacatggtagtgcatttggggatggatgtgttaatccaggaacaaatagaggatatcgtatacttgtaactggaggaacgattttaccttatatgacaggagtgggagattggatttttgacctaagtgctacaacaggagatgttatagtaacaggtggttcattaaaagcaacaacattcaaaagtttaggtggagcagttgcatacggtgatttagaaaagaaaacaaaagtttttatgaataaaatatctttaaagtatttaggacaagataaagttagtactacattagttgatgattttaaaatgctaattgatggaaaaatttatccttatggagcacctagttatacagatgatcaaggggttctttacttatggttttctgatcaatttaagggatctgaagtatctgttaatttagttgttatagataaaattactggaggaaatataaaaccagatgatttttatgttaaagatataggttcaggttctcaatttttaaagcaatatgaagaatttactattgatgatactccaccatatttgattattaaaagatatgatggattaccatttgaagaagatgtagaaaaattatttttagattggatattaaaagatgggggtattccaataattactcctaaaggtgaaaaactcacagataaaaaatttatgactattagttctcaacgtttaaatgaggaaacaatggaaccagatacaaatttaggaagtgatgaccttacaaagcaagttgatgctggaaaatatcaattaagcattacatcaacacagttttcaaatgtatatccttttaatgaagcttattgggggcatagagcatattataaggcagaaattattcctgctgatacagaaacttcattagttgtagaagagtctaaagctaaaactgatgtttttaaaccaacagatacgtttacattaaatgttactatttcaccagataagaaagaaggaacagattgtgcctctccaagaggttacgtacaattctatattaatggaaaggaatataaagatccagtagaattaaaaactcataataagggtagtgagagtcataattatagtactgcatctattgaatggagacctttagatagcaatcatcatatttttactactgaacaaactattactgtaaaatatattggagatgatataaattacattgaaggtagtgaggatgaaaagaagttaaagttagatatgacaaatgtagatgtagatggggatggaataccggatataaatatagacactgatggtgatggaaggccagatatcaatatagatacgagtggtgattggaagccagatattaacatagatactgataatacaggtgaatggaagcctagtacagaaggtggaaatggagatggtatttggaaacctgataaaaatatagataccaatggagatggaaaccctgatacagattataatcgtccagcaatagatacagataatgatggagtagatgattattggaagcctgataaaaatgtagatactggctcaggaggttatgatacaggtaatccaaatctaaataagccagatccagataatggaggaaatagcaagccggatccagataatggaggaaatagcaaaccagattcaggtaatggaggaaatagcaaaccggattcaggtaatggaggaaatagcaaaccagattcaggtaatggaggaaatagcaaaccggattcaggtaatggaggaaatagcaaaccggatccagataacggaggaaatagcaaaccagatccagataacggtggcaatggtaaaccagatccagataatggaggaaatagcaaaccggatccagataacggtggaaatagtaaaccagacccagataatggaggaaatagcaaaccagatatagatacagatggggatggaaaaccgaatataaatatagacacagatggagatggaaaaccagatataaatatagatacagatggagatggaaaaccagatataaatatagatatagatggagatggaaaaccggatataaatatagatacagatggggatggaaagccggatataaatatagatacagatgggaatggaaaaccagatataaatatagatacagatgaaagtttagatagtaatgtaggtcaaaatgtacaaacaggagatcaaagtaatataatgctagatttagcattaatgttcattagcttgttttttttaattaaaaatctaacaaataaatacttaagacgtaaa

SEQ ID NO: 115 - protein, 1190 aa, Clostridium difficile
MQQKCKKKALSMILSISMGLGSVASFNASNTFADTIEESTNAGNAEGDTNAGNAGGDANAGNAGGDANAGNAGGDANAGNAGGDANAGNAEEDSNAGNAEGDANAGNAEEDANAGNAEEDSNAGNAEEDMNALVVEEATAEDPTSVGDFKISGGEINVDFKFASGVLTILSGKQMTIQNNNPNTPTTHRIVIPKDVKAELIFDGVNIKTASNSPFTLTPDKDGGAYAHVILQDGSENKLESGDVYYPGMRAGKGTTLTIDDSVVNRDIEGEFIVPEGGKIPRDVTLENGDKLKKGDRLTLLDSNNRGSLKVVGNYYSAGIGGGNTESGGNIIINGGAITAIGQESSRNTGYGAGIGGGGNGSGGDITINGGTITAKGAYHGAGIGGGYYTTTKNALSPSVVDPSTGSGYSGNITINGGLSYSYGGAHGSAFGDGCVNPGTNRGYRILVTGGTILPYMTGVGDWIFDLSATTGDVIVTGGSLKATTFKSLGGAVAYGDLEKKTKVFMNKISLKYLGQDKVSTTLVDDFKMLIDGKIYPYGAPSYTDDQGVLYLWFSDQFKGSEVSVNLVVIDKITGGNIKPDDFYVKDIGSGSQFLKQYEEFTIDDTPPYLIIKRYDGLPFEEDVEKLFLDWILKDGGIPIITPKGEKLTDKKFMTISSQRLNEETMEPDTNLGSDDLTKQVDAGKYQLSITSTQFSNVYPFNEAYWGHRAYYKAEIIPADTETSLVVEESKAKTDVFKPTDTFTLNVTISPDKKEGTDCASPRGYVQFYINGKEYKDPVELKTHNKGSESHNYSTASIEWRPLDSNHHIFTTEQTITVKYIGDDINYIEGSEDEKKLKLDMTNVDVDGDGIPDINIDTDGDGRPDINIDTSGDWKPDINIDTDNTGEWKPSTEGGNGDGIWKPDKNIDTNGDGNPDTDYNRPAIDTDNDGVDDYWKPDKNVDTGSGGYDTGNPNLNKPDPDNGGNSKPDPDNGGNSKPDSGNGGNSKPDSGNGGNSKPDSGNGGNSKPDSGNGGNSKPDPDNGGNSKPDPDNGGNGKPDPDNGGNSKPDPDNGGNSKPDPDNGGNSKPDIDTDGDGKPNINIDTDGDGKPDINIDTDGDGKPDINIDIDGDGKPDINIDTDGDGKPDINIDTDGNGKPDINIDTDESLDSNVGQNVQTGDQSNIMLDLALMFISLFFLIKNLTNKYLRRK

SEQ ID NO: 116 - DNA, 1650 bp, Clostridium difficile
atgaataagaaaaatttagctatattaatatcaggtatgatgtttttttctagttcttcagcaatttttgcagacaatactacaaagcaagaaagattaataggtaaaacaagatatgaaacagcagtagaagtaagtaaattgggatgggttcaatcaaaaacagccattatagttaatggtaattctattcaaagtgcgctttgtgcaaatccatttgctaagctaaagaatgcacctatacttttagtaaacaacaacagtattgaaaattcaactaaggctgagcttaaaaggcttggtgtagataatgtgtacattgtagatagtggaaatagcatttcttctaaagtagaaaatgaaataaaatcacttaacataaaaataaataaaatagtaggaaacaatatatatgaaatgtctacaaatgtacttaaagaaatagataagataaaaaagatagaaaatgttgcagttgtaaatggactaaagggactatctgatgcagttagtatagcttctccagcagcaatacataatatgcctataatattagtatcagatgaaaacagcaatgatagtagtataaatttcttaaacaataggtctataaaaaaatcttacatagttggaggaaataagattttatcagacaatacagtaaagaaatatccaaacagagaaagaatcagtggttcagatagaaacaatactaatgcaaaaattattgataaattttataaagataaaaaaataaataatgtatttgtagctaaagatggtattaaccaagaaaatgcattagtagattcattatcaataggagtactagctgctaaagaaaattctcctataatgatatctaatggtagccttgtaaatagtcaaaaagaatttattaaaaataaagatatagatgaaataacacaagtaggaggaggatataatcaaaaagcatttgaagatattttaaaactaaaaaatgtgaacataagaaataaaactaaaaaaatatctttaatacaggctaaagaaatattaaaacaagctcttccaggaagcaatattttagtttgttattatgatgaagatgataatgaatatgactgcaaagttataaaggataatatcctatatgagatagaaattgatgcctactctggtaaaataatagaaattgaaaaagatgatgacttaaatgataataatttaggtacacaaaatatatcattggataaagctaagtctatagcattagatgctgttcctaatggtaatttaatctattgtaaatatgatgctgaagataacgaatacgaggctaaagtaataaaaaataagaaaacatatgaattagagataagtgcatttgatggaagaattgtagatattgacatggacaatgattctgatgatgactttgatgataatgataagaataactctaatactaatgacaacagttctattattagtgctgaaaaagctaaatcaataatgctagataaagtgcctggtgggaaaatagtaaaatttaagtatgatgaagatgacaaagaatatgaaggtgaaataataaaaggaaaaactgaatatgagataacaattaatgcaattactggtaaaatattagaatttgaaatagatgat

SEQ ID NO: 117 - protein, 550 aa, Clostridium difficile
MNKKNLAILISGMMFFSSSSAIFADNTTKQERLIGKTRYETAVEVSKLGWVQSKTAIIVNGNSIQSALCANPFAKLKNAPILLVNNNSIENSTKAELKRLGVDNVYIVDSGNSISSKVENEIKSLNIKINKIVGNNIYEMSTNVLKEIDKIKKIENVAVVNGLKGLSDAVSIASPAAIHNMPIILVSDENSNDSSINFLNNRSIKKSYIVGGNKILSDNTVKKYPNRERISGSDRNNTNAKIIDKFYKDKKINNVFVAKDGINQENALVDSLSIGVLAAKENSPIMISNGSLVNSQKEFIKNKDIDEITQVGGGYNQKAFEDILKLKNVNIRNKTKKISLIQAKEILKQALPGSNILVCYYDEDDNEYDCKVIKDNILYEIEIDAYSGKIIEIEKDDDLNDNNLGTQNISLDKAKSIALDAVPNGNLIYCKYDAEDNEYEAKVIKNKKTYELEISAFDGRIVDIDMDNDSDDDFDDNDKNNSNTNDNSSIISAEKAKSIMLDKVPGGKIVKFKYDEDDKEYEGEIIKGKTEYEITINAITGKILEFEIDD

SEQ ID NO: 118 - DNA, 2220 bp, Clostridium difficile
gtgaatacaatatatgtttttagtatcaggagaattttgaaaacaaaaattaaaaaatcaagtataatcagtttagtaattgcttttagtatggtatttactgcatttacaccaatagtatcttatgctgacgaagtgactagcaatgatacaatacttaatggagaagaacaatcaaatggtcagacaccagatgtagagaaaccatcagacggtcaggtaccaggtggggagaaaccatcagacagtcaagtaccagatggggagaaaccatcagacggtcaggtaccagatggggagaaaccatcagatggtcagataccagatggggagaaaccatcagatggtcagataccagatggagagaaaccatcagatggtcagataccagatggggagaaaccatcagatggtcagatgccagatggagagaagacatcagatagtcagacgccagatgtagagaaaccatcagatggtcagatgccagatggggagaaaccattagatgagcaaactccagaagaagaaaaaccattggaagaagaaatagttatagaggaaatgagtttaaaacaagatattgataaaattcttgatatgactttatctcaaataaataaaatagtatataacttttgggaagatgaagaagatgtaaaggcagatgaacaatcagaaattaaccaagtttttacttcagaagactcatttattagcttatggtatgacaaaaaagcaaaagtaaaaaattcttgtttactaaaagaaatagatggttcagatagaccttatcatgatttaagatttgatgatattacaaagactttaacttttgactatgtaataaagggtcttgtaggagcaagctcaaaagacgacaaatatgtaatagaaggtgaagatggagagcaaactgcattttgttacaataatcatttaagaccaccaagtagtaatggaaagagtccatatttaccagcagaagattttaatggtcaagaaaaccaaaatgaagaagcagttaaatctatactatatgcaggttctgaatttgatggatttggatataagcaacaatttaatttaggtggagaagaaaatgaattgatgacttactcagctactcaaagtgcaatttggattattcttggacaaatggatgaacaagaaagacttaagcagtatcaaggttctataaacctttgtgataaacttatagaaagagcaaaaactgaagaggaaagagctgagtatcagaagaagaaagaagtagcgataaatataaaagcttatttagaagcattgttaaaagcaggtcgtgaagagttaaagccaaataatacaggaaaacctagtttgagtaatggtttaactaagattaactttgaaaaaaatgaagatggtacttatgaaacagaagctgtagccttagtaggttatagtggtgtagtaaagttaagactaccagatggagtaactgcttatgatgtagatggtaatataataggtacaggcgaagtagaaatttcaacgcaacagaaatttaaacttaagagtgttggaaaaccagatgccaaagctaatatttctgctgtatcttatgattatatttttccaaaagctattcaatattataaggcagtgcttgatttaggacaaaaagaccattcatcttcattaccatctagcaagcaaaatttattaagttatacaatagagaaaaagaatggtcaagaagttaactttaatataggtttaccaacagatgatgatgatgttgtaaatccaccagtgccaccaatagatgatgatgttgtaaatccaccggtgccaccaacagatgatacaaatggacataagccaaaaccatcaccaccaatagatgatacagtaataaatccaccagtaccaccaatggatgatacaataataaatccaccagtaccaccaacggaggatgcagtgttaaacccaccagtgccaccaatggaggatgcagtgctaaatccaccagtgccaccaacagatgatacagtgttaaatccaccagtaccaccagtaagtgatacagtggaaaaaactccagaactatcaagagatgatacaatagtaaaatcaccaaaaacaggtgatgaaactcagctaatgtcatatgtatttattagcgtcattgcaatttgtggattagcgtatcaatgtaaaataaaaagaaattaa

SEQ ID NO: 119 - protein, 739 aa, Clostridium difficile
MNTIYVFSIRRILKTKIKKSSIISLVIAFSMVFTAFTPIVSYADEVTSNDTILNGEEQSNGQTPDVEKPSDGQVPGGEKPSDSQVPDGEKPSDGQVPDGEKPSDGQIPDGEKPSDGQIPDGEKPSDGQIPDGEKPSDGQMPDGEKTSDSQTPDVEKPSDGQMPDGEKPLDEQTPEEEKPLEEEIVIEEMSLKQDIDKILDMTLSQINKIVYNFWEDEEDVKADEQSEINQVFTSEDSFISLWYDKKAKVKNSCLLKEIDGSDRPYHDLRFDDITKTLTFDYVIKGLVGASSKDDKYVIEGEDGEQTAFCYNNHLRPPSSNGKSPYLPAEDFNGQENQNEEAVKSILYAGSEFDGFGYKQQFNLGGEENELMTYSATQSAIWIILGQMDEQERLKQYQGSINLCDKLIERAKTEEERAEYQKKKEVAINIKAYLEALLKAGREELKPNNTGKPSLSNGLTKINFEKNEDGTYETEAVALVGYSGVVKLRLPDGVTAYDVDGNIIGTGEVEISTQQKFKLKSVGKPDAKANISAVSYDYIFPKAIQYYKAVLDLGQKDHSSSLPSSKQNLLSYTIEKKNGQEVNFNIGLPTDDDDVVNPPVPPIDDDVVNPPVPPTDDTNGHKPKPSPPIDDTVINPPVPPMDDTIINPPVPPTEDAVLNPPVPPMEDAVLNPPVPPTDDTVLNPPVPPVSDTVEKTPELSRDDTIVKSPKTGDETQLMSYVFISVIAICGLAYQCKIKRN

SEQ ID NO: 120 - DNA, 1032 bp, Clostridium difficile
atgtttaagaaaaagttaatagctgttgcaatgagtataactatgattagtgtagggagcttttcgtatgctcattcaggaagaactgattcatcaggaggtcatcgtgataataaaaataaatctggattaggaagttatcactatcattgtggtggttatccagctcatttacataataatggtggttgtccttatactggaggaggaagcagttctggaacagcaacttcggttaataatgaagaaaagcaaaagaggtctgttggagaaaaaggatataatcaagggtatgaagatgggtataaaggaaattatagttcatcaaattatagtggagattatagtgatacatatgaatcaaagtactcagaaggatatgaaaaaggtaaggctaaattagaagaggaagaaaaggtggctaaagagactggatataatttagggcttacaggtgctaaatctaataatacatatgaaaaagaagttttaaaaaatgcttatgataccggatattcaactggatacaatgaatataagactaaaaagatagaagaatataaagctaaagggatagaggatagcaataaagataaggaaaaaatgacatttgaagaaaacatagattctgaatttatagatgcttataataatgcttatgacgaaatacaagaacaattaaaaaatgattacactactcaaggatttgagagtgctatcaaaggagaaagatttgacacatcaactataggtaatgttaaatatgctaattggtttaaagaaggatatgataatggtaaggttaagttacctaaagcaaaagaaagtgtatataatcaaggttacaatgaagaagattttagtataccagatgaaatgaagtctattgaaactaagttaaaaggtgtatatgatgaaggtttagaaaaaagagaggaagagaaaagtagaaatgctacttatggggttggagctggaacagcagctgtagttgctggagtagtatataagaagaaaaaacgtaaaaagata

SEQ ID NO: 121 - protein, 344 aa, Clostridium difficile
MFKKKLIAVAMSITMISVGSFSYAHSGRTDSSGGHRDNKNKSGLGSYHYHCGGYPAHLHNNGGCPYTGGGSSSGTATSVNNEEKQKRSVGEKGYNQGYEDGYKGNYSSSNYSGDYSDTYESKYSEGYEKGKAKLEEEEKVAKETGYNLGLTGAKSNNTYEKEVLKNAYDTGYSTGYNEYKTKKIEEYKAKGIEDSNKDKEKMTFEENIDSEFIDAYNNAYDEIQEQLKNDYTTQGFESAIKGERFDTSTIGNVKYANWFKEGYDNGKVKLPKAKESVYNQGYNEEDFSIPDEMKSIETKLKGVYDEGLEKREEEKSRNATYGVGAGTAAVVAGVVYKKKKRKKI

SEQ ID NO: 122 - DNA, 1905 bp, Clostridium difficile
atgaaagataaaaaatttacccttcttatctcgattatgattgtatttttatgtgctgtagttggagtttatagtacatctagcaacaaaagtgttgatttatatagtgatgtatatattgaaaaatattttaacagagacaaggttatggaagttaatatagagatagatgaaagtgacttgaaggatatgaatgaaaatgctataaaagaagaatttaaggttgcaaaagtaactgtagatggagatacatatggaaacgtaggtataagaactaaaggaaattcaagtcttatatctgtagcaaatagtgatagtgatagatacagctataagattaattttgataagtataatactagtcaaagtatggaagggcttactcaattaaatcttaataactgttactctgacccatcttatatgagagagtttttaacatatagtatttgcgaggaaatgggattagcgactccagaatttgcatatgctaaagtctctataaatggcgaatatcatggtttgtatttggcagtagaaggattaaaagagtcttatcttgaaaataattttggtaatgtaactggagacttatataagtcagatgaaggaagctcgttgcaatataaaggagatgacccagaaagttactcaaacttaatcgttgaaagtgataaaaagacagctgattggtctaaaattacaaaactattaaaatctttggatacaggtgaagatattgaaaaatatcttgatgtagattctgtccttaaaaatatagcaataaatacagctttattaaaccttgatagctatcaagggagttttgcccataactattatttatatgagcaagatggagtattttctatgttaccatgggattttaatatgtcatttggtggatttagtggttttggtggaggtagtcaatctatagcaattgatgaacctacgacaggtaatttagaagatagacctctcatatcctcgttattaaaaaatgagacatacaaaacaaaataccataaatatctggaagagatagtaacaaaatacctagattcagactatttagagaatatgacaacaaaattgcatgacatgatagcatcatatgtaaaagaagacccaacagcattttatacttatgaagaatttgaaaaaaatataacatcttcaattgaagattctagtgataataagggatttggtaataaagggtttgacaacaataactctaataacagtgattctaataataattctaatagtgaaaataagcgctctggaaatcaaagtgatgaaaaagaagttaatgctgaattaacatcaagcgtagtcaaagctaatacagataatgaaactaaaaataaaactacaaatgatagtgaaagtaagaataatacagataaagataaaagtggaaatgataataatcaaaagctagaaggtcctatgggtaaaggaggtaagtcaataccaggggttttggaagttgcagaagatatgagtaaaactataaaatctcaattaagtggagaaacttcttcgacaaagcaaaactctggtgatgaaagttcaagtggaattaaaggtagtgaaaagtttgatgaggatatgagtggtatgccagaaccacctgagggaatggatggtaaaatgccaccaggaatgggtaatatggataagggagatatgaatggtaaaaatggcaatatgaatatggatagaaatcaagataatccaagagaagctggaggttttggcaatagaggaggaggctctgtgagtaaaacaacaacatacttcaaattaattttaggtggagcttcaatgataataatgtcgattatgttagttggtgtatcaagggtaaagagaagaagatttataaagtcaaaa

SEQ ID NO: 123 - protein, 635 aa, Clostridium difficile
MKDKKFTLLISIMIVFLCAVVGVYSTSSNKSVDLYSDVYIEKYFNRDKVMEVNIEIDESDLKDMNENAIKEEFKVAKVTVDGDTYGNVGIRTKGNSSLISVANSDSDRYSYKINFDKYNTSQSMEGLTQLNLNNCYSDPSYMREFLTYSICEEMGLATPEFAYAKVSINGEYHGLYLAVEGLKESYLENNFGNVTGDLYKSDEGSSLQYKGDDPESYSNLIVESDKKTADWSKITKLLKSLDTGEDIEKYLDVDSVLKNIAINTALLNLDSYQGSFAHNYYLYEQDGVFSMLPWDFNMSFGGFSGFGGGSQSIAIDEPTTGNLEDRPLISSLLKNETYKTKYHKYLEEIVTKYLDSDYLENMTTKLHDMIASYVKEDPTAFYTYEEFEKNITSSIEDSSDNKGFGNKGFDNNNSNNSDSNNNSNSENKRSGNQSDEKEVNAELTSSVVKANTDNETKNKTTNDSESKNNTDKDKSGNDNNQKLEGPMGKGGKSIPGVLEVAEDMSKTIKSQLSGETSSTKQNSGDESSSGIKGSEKFDEDMSGMPEPPEGMDGKMPPGMGNMDKGDMNGKNGNMNMDRNQDNPREAGGFGNRGGGSVSKTTTYFKLILGGASMIIMSIMLVGVSRVKRRRFIKSK

SEQ ID NO: 124 - DNA, 2079 bp, Clostridium difficile
atgaaaaaatttattatatcaattatatctttagtattgtttttttcaaatatatcacttatatacaaagtaaatgctgatgagactaaagttaaaaattataagtttgaaagagatataactattgatggtgttataggaagtaatagtactttttttgaagtaaataaaaattgggatattgaagaagttttattgcatcttaattttagtaagagccaaatattaaatggagatgtttcaagtttaactgtattgataaataatgtaccaataaaatctattaaattaaatgctaagacaaattataaaaatacattagaagtattagttccaaaagattatataattcaaggatataatgaaataaaaataaaaacatacaaaacaatatctgataaaatttgccaggatgattccaatactgggaactggatggttattcacaaagaatcatatatatcaattagatataagcagaaaaaggtggaaaactcaataaatgaatatccgtatccatatgcagaaattgaaaataatcataaattagatacaactatagtagtaccagataatatgactagaggagagactacagcagtgtttaatttggcatcagcatttggaaaaataacaaaaaatgatgatttaaagttagatgttaaattatattcagaaatgaaaaattggtcagatgataatattatatatattggtaaacctgaaaatacagcagaagaaattttggatattttaagtataaaggaacaaaccctattatcttcaaactgtataatcaagcaagtagattcaccatacaataagaataagaagatgatggtggtaattggtagtaatgaagatgatttaataaaggcatcaaatttattaatagaaaatagactttctaatcaagttttatcatcatcagtacttgtaaacaaagagactaatataaaaattaatagggaacaaaaattaaatttaggtcatttaacattaaaagacttaggatattctgactttttgttggaaggagcatttaatcaacaagctttatttgatgtcaaaataccaacgggtaaggtattagatgatggttcaaagattatcttaaatttaagatattctgacaatttagattttgaaaaatctttagttacagtgtctataaatgatgttattgtgggaagtaaaaaattggataggtcacattctaataatgataagttagaattaaaaatacctaaagatatagataataaaaactattatcaagttaaattgacatttaatttgagtataaaaaattcgaattgtgttactagagagagtaataatccttgggcatatgtatcaaataattcttatttggcgttatctacgaaagaaaatgaaaccttatcttttgaaaattatccgtatccatttgttagagatgatgaatttaatgatttaactgtgataatgccagattattcagggtcacaagctatgacctggatgtttagattaggtgttactttaggtgcgaatataaattcacataatggaaatataaatgtaattagaggaaaagaatttagtgacaagtataaggatactaatattgtagtttttggagtgccacataataattctgttataaagatgttaaataataatttaaatataaagttcgataaaaattactccaattttatatcaaatgataagataagctttattgatgattatggaaaaaatatttctaccattcaattaataaaatcaccatataataatcaaaaaaatatcatggtaattagttcaatgaatgaaaaaaacttatatttaggaatggattatttgttgaataaaagtaaagttaatgatttaaaaggagatacattgataattgatgaatacggagaggtagaagatttagcttataatttaaaatctaagaaagaagtaaaagattcaagttggaatatgagtataaataagacaactaaagtatttttaatgatttcttttattactataattgtagtcatgatattatcaatgctatatataaaaaaatataaaagaaga

SEQ ID NO: 125 - protein, 693 aa, Clostridium difficile
MKKFIISIISLVLFFSNISLIYKVNADETKVKNYKFERDITIDGVIGSNSTFFEVNKNWDIEEVLLHLNFSKSQILNGDVSSLTVLINNVPIKSIKLNAKTNYKNTLEVLVPKDYIIQGYNEIKIKTYKTISDKICQDDSNTGNWMVIHKESYISIRYKQKKVENSINEYPYPYAEIENNHKLDTTIVVPDNMTRGETTAVFNLASAFGKITKNDDLKLDVKLYSEMKNWSDDNIIYIGKPENTAEEILDILSIKEQTLLSSNCIIKQVDSPYNKNKKMMVVIGSNEDDLIKASNLLIENRLSNQVLSSSVLVNKETNIKINREQKLNLGHLTLKDLGYSDFLLEGAFNQQALFDVKIPTGKVLDDGSKIILNLRYSDNLDFEKSLVTVSINDVIVGSKKLDRSHSNNDKLELKIPKDIDNKNYYQVKLTFNLSIKNSNCVTRESNNPWAYVSNNSYLALSTKENETLSFENYPYPFVRDDEFNDLTVIMPDYSGSQAMTWMFRLGVTLGANINSHNGNINVIRGKEFSDKYKDTNIVVFGVPHNNSVIKMLNNNLNIKFDKNYSNFISNDKISFIDDYGKNISTIQLIKSPYNNQKNIMVISSMNEKNLYLGMDYLLNKSKVNDLKGDTLIIDEYGEVEDLAYNLKSKKEVKDSSWNMSINKTTKVFLMISFITIIVVMILSMLYIKKYKRR

SEQ ID NO: 126 - DNA, 3399 bp, Clostridium difficile
gtgattataataaattatgaattaattgtaaaatacaatggagatatattgaggttagaagaagaattaggtgtatcagtagagatacttaattcatcatatgcaataataacatcaagtaatgaagaagatgtaaatatacttttaacttatccagaaattgaatttatagaaaagccttttatattacagactcaggatgtgcaaagtttttcaagtacaggaataacaggatttaaaaatagaactggtttaactggaaaaggaactataattggtataattgattcgggaatagattatactctacctgtgtttagagatagtgatggaaggtctaagatattatattattgggaccaatctattcaaggaaatccaccagaaggttttagagaaggaacattatatactaatgaagatataaataatgcaatagatggaagtatgtatatacctatttcaacaactagcttacatgggacacatgttgcaggtatttgtgcaactattgcaagtgatgccagaataatagtggttagagttggaaatatacagaccgatattttttcgagaagtacagagtttatgagggcaattaaatttattttagatagggcattagaattaagaatgcctgttacattaaatataagttatggaagtaatgaaggttcacatagaggaacatctttatttgaacaatatatagatgatatgtgtttattttggaaaaacaatatagttgtagcagctggaaataatgcagataaaggaggtcataaaaggattaggcttcaaaataatattacagaagaagttgagtttatagttggggaaggagagcgtatattaaacataaatatatggccagattttgttgatgattttagtgtacatttggtaaacccatcaaataatcaaacacaagcaatctctctaacttcaggtgagataaggaatactttgggtgaaactagaataactggttatttttaccctatagcaccgtattctctcacaagaagagttactctacaattaagttcaaatacacagataactcctgggttatggaaaattgtatttgaaccaatagatatagtaactggtaatgtaaatatatatttgccaacttctgaaggtctaaatagaaatactagatttctgattcctactcaagagcttactgtaacagttcctggaacagcaagtagagttataacagtaggtagttttaattcaagaacagatatagtatctatattttctggtgaaggagatacacaattaggtgtttttaaacctgatttattagctccaggtgaagatatagtatcttttttaccaggaggtacaagtggagcattaactggaactagcatggctacacctcatgttacaggggtttgttcattgtttatggaatggggaattgtaaatggaaatgatttatttttgtattcacagaaattaagggcattacttctaaagggagcaaggagattaagtaatcaatcttatccaaataattcatcaggatttggttttttaaatttatcagatatagatttgtacactctatctaatataaatcaagacttagaaacagaggatatgggatatagaagtattaataagtcatttaaagatgaggaaaatagttataagtttatagatggttataatatgcaaatacataatgacttagagaatgaaatttatataagtaaaaatgcaagtagacaatcaggaatactatcaggaatagatatagtccatactcctgaatttgaagaagaactagctgggttaggtatgagtcaaaggttttttaagataagtgattcattaggtgtactatctataaataatacagactatagtagtatacaacgagttttgcaacttccttcaatcataagaactgtatcgactacaaagatgacattacttggagaaattaatcgaggtacttttggaggtgtagttgcaacagaagaaatgggcgtaaatttctttaaaaataatcctaatattaatataacaggaagagggactctaatatcaattgcagatacaggaatagactatctacacccagattttatttatccagatggcacttcaaaaatagtatatttatgggaccaaacaaaagaaggaactcctcctgatggtttttatattgggacagaatatacacgagaagatataaatcgagctatcgcagaaaatgaccctagtctatctcaggatgaagttggtcaaggaactatgttgagtgggatatgtgcagggcttggaaatgtaaatagtgaatatgcaggtatagcagaagattctgagctaataataataaaactcggcaagatagatgatttttataatagtgcaatgttgtttgctgcatctcagtatgcatataaaaaagcttttgaacttggaagaccattagttataaatatgtctttaggtaccagtagcctagcaggtttaaccaataggagtaatagtgaaaaagcgttctttactagagggttatgtataacggcaggagcaggaaatgagggcaatacacagacacatacatctggaataataccatatgttggaggttctgttgaagttgaattagagttaaatgaagacgaggaagaattatcattagaactttggttaaatagaccagataaagctgatgtaataatagtatctcccactggtgaagaaagtaaaagtgttggaatttcaaattataataaagtaacaggtttatttgatttagaggggactgaatattctataacatatatatacccaacaactttttctggacagcaatttactaatgttactttaaagaatgcaaaaagaggtgtatggaagattcgattagtaggagtttatattataacaggaagatataacttataccttccaaatagagaacttttaaaaagtggaactagatttagagaggtagaccctttttacactataaattatcctgcgattcaagatgatttaataaccataggagcctacaatactattaatggtagtttatggcaaagttcatcaagagggccaactattgaagacaggttaaaaccagatatagtagcaccaggtgttaatataatagctgcttatcctgggaacacgtatgcaactataactggtacagcagcagcaagtgcacatgcagctggtgctgctgcaatgtattttcaatatacttttgttgacggtagatatccaaaccaagcatatgtgcaaaaaataaaaacttttatgcaagctggtgctagaaaagattcaaacacagtatatccaaatacaaattctggatatgggctcttggatgttagaggaatgtttgatgttttaagatag

SEQ ID NO: 127 - protein, 1132 aa, Clostridium difficile
MIIINYELIVKYNGDILRLEEELGVSVEILNSSYAIITSSNEEDVNILLTYPEIEFIEKPFILQTQDVQSFSSTGITGFKNRTGLTGKGTIIGIIDSGIDYTLPVFRDSDGRSKILYYWDQSIQGNPPEGFREGTLYTNEDINNAIDGSMYIPISTTSLHGTHVAGICATIASDARIIVVRVGNIQTDIFSRSTEFMRAIKFILDRALELRMPVTLNISYGSNEGSHRGTSLFEQYIDDMCLFWKNNIVVAAGNNADKGGHKRIRLQNNITEEVEFIVGEGERILNINIWPDFVDDFSVHLVNPSNNQTQAISLTSGEIRNTLGETRITGYFYPIAPYSLTRRVTLQLSSNTQITPGLWKIVFEPIDIVTGNVNIYLPTSEGLNRNTRFLIPTQELTVTVPGTASRVITVGSFNSRTDIVSIFSGEGDTQLGVFKPDLLAPGEDIVSFLPGGTSGALTGTSMATPHVTGVCSLFMEWGIVNGNDLFLYSQKLRALLLKGARRLSNQSYPNNSSGFGFLNLSDIDLYTLSNINQDLETEDMGYRSINKSFKDEENSYKFIDGYNMQIHNDLENEIYISKNASRQSGILSGIDIVHTPEFEEELAGLGMSQRFFKISDSLGVLSINNTDYSSIQRVLQLPSIIRTVSTTKMTLLGEINRGTFGGVVATEEMGVNFFKNNPNINITGRGTLISIADTGIDYLHPDFIYPDGTSKIVYLWDQTKEGTPPDGFYIGTEYTREDINRAIAENDPSLSQDEVGQGTMLSGICAGLGNVNSEYAGIAEDSELIIIKLGKIDDFYNSAMLFAASQYAYKKAFELGRPLVINMSLGTSSLAGLTNRSNSEKAFFTRGLCITAGAGNEGNTQTHTSGIIPYVGGSVEVELELNEDEEELSLELWLNRPDKADVIIVSPTGEESKSVGISNYNKVTGLFDLEGTEYSITYIYPTTFSGQQFTNVTLKNAKRGVWKIRLVGVYIITGRYNLYLPNRELLKSGTRFREVDPFYTINYPAIQDDLITIGAYNTINGSLWQSSSRGPTIEDRLKPDIVAPGVNIIAAYPGNTYATITGTAAASAHAAGAAAMYFQYTFVDGRYPNQAYVQKIKTFMQAGARKDSNTVYPNTNSGYGLLDVRGMFDVLR

SEQ ID NO: 128 - DNA, 3045 bp, Clostridium difficile
atgaaaaagatattaaaacgattgtgtacgggcttcttagcttttgcaactgtcgttaccgctttaccgagtacacccgttcatgcagaaagtaagcaatactggacggaaagtgcagagcgagtcggtatcattgaaaaagtaatgaatgacggttctatcggttctacattcaatgagggcatgatgaaagttgagggcgaaactgcctattgtattgacatcaatactgactttaagaatggttacaagaccagagctgacgcaagctcacgcatgagtgccgaccagatttcagatgtggcgttatccttagagtatgtcaaacagtatggcgaagctcacaaggaattgaactacaaacaagtctatctgttggaacaatgtgttgtctggcagagattaagcgtacatcttggctggcaatgcgacaacgtgcgagcttcttatgatgaaattccaaaggcaacgcaggacgaagtttttgctggtgcaaaagcctttgtcaaagaaaataaaggacgctatgaatgtggcggttatatctactctggcgaggggcaggaattgggacaattctgggcgaagctgaatgttggaaatgcaaaactgcaaaaaacctccagtaataccagcattacagacggtaacgggaattactctatcgctggtgcaacctacggtgtcttttctgataaggactgcacaaaacagcttgccacccttacgactgataaaaacggaaatacagatgttatagaggtaaaagctggcacagtctatatcaaggaattatctgcaccagcaggatataaagtggataaaacaatctatccattgacaatcaaagctggcgaaacagcgaccttgaaagtatcagatacgccaaaagtaacagacactttagttgagcttttcaagattgacatggaaacacagaaagacaatccgcaggggaacgcttctctagcaggtgcggaatttacatggaaatattatgctggcttctacaataaagacaatcttcctgccgaagctactcgtacatgggttacaaagacaatcgctgaaacagacagcgacgggacaacccactacatcacaaaattagcggacgcatacaaggtatctggcgacagcttctatatgcaggacggaaaagccgttcttcctttaggaacattaaccgttgaggaaacgaaagctccaaacggctacttgttagacggtgcatatatgcaggctggcgacaagtccgaacagattaagggcttatatcttacacagattaccgaggacggcgaccttgccgtattgactggaagtaaccagttttctgtatcagataaggttatccgtggcggtgtgaaaattcagaaacgagatttagaaacgggtgacacaaagccacaaggaagtgccacattgaaagatactgcctttgacatcatttccttaaatgataatgcggtattggttgagggcaagctatacaagaaaaatgaagtcgtaaaaaccattcatacagaccttgagggtgtggcttctacttctgccgaccttttaccttatggaaaattccgtatcgttgagagtgaagctcccgacggatatttgacagacggtgcgaagccgattgactttgcaatcacagaaaacggaaaaatcgtggacttaaccgatgaagcccattctatctacaatcagattaagcgtggagatattgagggcgtgaaaatcggtgcaggcacacacaagcgtcttgctgatgttccttttaggatcacaagtaagacgactggggaaagtcatgttgtggtaactgatgataacgggcaattttccacttctgctgactgggcttctcacaagcacaataccaacgcaggaaagaccagcgaggacggtgtatggtttggagcttctgaaccagacgacagcaagggtgcattgccttacgatgcttacatcattgaagaattgaaatgtgaaagcaacaaaggctttgaacttatcccgccttttgaaatcgtagtatcaagaaataaccttgtgattgatttagggactttgactgatgaatacgaaaaagaaatctctatccataccacagcgaccagcaaagacggcgaaaagactatccttgcaggaaaagaggtaacaatcgttgatacagtcaaattggacggacttacaaaaggtacaaaataccagttaaaaggctggcagatgttaaaggaagaaaacgccgagctaatcattgacgggaaacgtgtggaaaacgactatacctttatcgctgatgaggaagaaatgaaagtggaaatttcctatacatttaatgcgtctgctttaggtggcaagaaccttgttacctttgaagaattgtatgatttaagcaatccagacgaacccgtgaaagttgcggaacacaaggacattgaggacgacgggcagacggtacttatcacagagcgtatcatcaaaattcatacaactgctaccgacaaggacggcaacaaagagcttgaagcaggaaaagacgttacaatcattgataccgtaaccttagagggcttagaagtcggaacacagtacaaacttgtgggctggcagatgttgaaagaagaaaatgcagagcttcttgtcaatggaaaacgtgtggaaagtgattacacctttatcgctgacagcgaaaatatgaaagtggaagttgcctttacttttgacgctacctcccttgacggcaaacagcttgtaacttttgaagaattgtacgacttaagcaatacagacgagccgaagaaagttactgaacataaggacattgaggacgagggacagacgattacctttaaggaaaaaccagaagttccagagaagcccgaacagccacagacaccagaaaagcctagcagacctagcgacagtcccaaaacgggcgacagtacaaaccttatggcttttatcgtgatgttgcttgtgtctggtggtggactggctggaacatatctttataaacgccgtaaaatgaagaaatcataa

SEQ ID NO: 129 - protein, 1014 aa, Clostridium difficile
MKKILKRLCTGFLAFATVVTALPSTPVHAESKQYWTESAERVGIIEKVMNDGSIGSTFNEGMMKVEGETAYCIDINTDFKNGYKTRADASSRMSADQISDVALSLEYVKQYGEAHKELNYKQVYLLEQCVVWQRLSVHLGWQCDNVRASYDEIPKATQDEVFAGAKAFVKENKGRYECGGYIYSGEGQELGQFWAKLNVGNAKLQKTSSNTSITDGNGNYSIAGATYGVFSDKDCTKQLATLTTDKNGNTDVIEVKAGTVYIKELSAPAGYKVDKTIYPLTIKAGETATLKVSDTPKVTDTLVELFKIDMETQKDNPQGNASLAGAEFTWKYYAGFYNKDNLPAEATRTWVTKTIAETDSDGTTHYITKLADAYKVSGDSFYMQDGKAVLPLGTLTVEETKAPNGYLLDGAYMQAGDKSEQIKGLYLTQITEDGDLAVLTGSNQFSVSDKVIRGGVKIQKRDLETGDTKPQGSATLKDTAFDIISLNDNAVLVEGKLYKKNEVVKTIHTDLEGVASTSADLLPYGKFRIVESEAPDGYLTDGAKPIDFAITENGKIVDLTDEAHSIYNQIKRGDIEGVKIGAGTHKRLADVPFRITSKTTGESHVVVTDDNGQFSTSADWASHKHNTNAGKTSEDGVWFGASEPDDSKGALPYDAYIIEELKCESNKGFELIPPFEIVVSRNNLVIDLGTLTDEYEKEISIHTTATSKDGEKTILAGKEVTIVDTVKLDGLTKGTKYQLKGWQMLKEENAELIIDGKRVENDYTFIADEEEMKVEISYTFNASALGGKNLVTFEELYDLSNPDEPVKVAEHKDIEDDGQTVLITERIIKIHTTATDKDGNKELEAGKDVTIIDTVTLEGLEVGTQYKLVGWQMLKEENAELLVNGKRVESDYTFIADSENMKVEVAFTFDATSLDGKQLVTFEELYDLSNTDEPKKVTEHKDIEDEGQTITFKEKPEVPEKPEQPQTPEKPSRPSDSPKTGDSTNLMAFIVMLLVSGGGLAGTYLYKRRKMKKS

SEQ ID NO: 130 - DNA, 4869 bp, Clostridium difficile
atgaaaataccaaagaagattgctgcaatgcttacagttacaatgatagctggaagttcaacagcaggcatagctagtgcacaaactgtggcaacaaatttaacagggcaagaaagatatgaaactgctgttaaaataagtcaagatggatggaaaaatgctgatgaggtagtaatcgtaaacgactcatctatagcagatgctctatctgcaacaccatttgcaaaagcaaaaaatgctccaatacttttaacaagtaaagataaattaaatgataagacgaaagcagaaatacaaagattaaaagctaaaaaagtatacttaataggtggaacttctgtattaagtacaaatatagaaaaagaaataaaagatttaaaaatatcttttgagagaatctctggagctgagagatatcaaacatccttagaattagcaaagaaattagatgctataagtgatgttaagaaaatagctgtagttaatggtgaaaaaggacttgcagatgctgtaagtgtaggagcaccagctgcacaaaacaatatgccagtaatacttgctgattctaaaaatggaacagcagttgcagacaaatttataaaggatgctggaataactcaatcttatgtagtaggtggagagagttcaatttctgaagctgttaaaaataaactaccaaatagtacaagactaggtggaacagatagaaatgatacaaatgcaaaagtaataaaagaattttataaaaagacagatttaaaaaatgcttatgtaactaaagatggtatgaataaacaagaccaacttatagatgcactagcagtaggtgtattaggtgctaaaaatcaatcaccagtagttttagttggaaagaacttatcagcttcacaaaaatctctagttaactctaagagttttgataagataactaaagttggtgggaatggtaatgagacagcatttaatgaaatgaagtcattacaagaagtaaaaacagttgaagccaaaacaatttctgaattaaaatcagctatagataaagctactgctaatgatgttataaacttcaaaccaactagtgaggttaaagaagcatttacaatacaaactgataaagcagtaacagtaaacttaaatggtacatatacaaagactgtgactatcaacatgcctaatggtgatgtaaataactatgcaaaagtggatgatgtagttatagatgatgtaaaagatggaacttttgttaactatggaaaaataactaacttaaaggttaatgataaaaatggagccaagatagaaaataattctaaaggtgagattggtagtttaacagtagcatctggagcaagtcaagtaaaagtgactaatggtggtaagataactacagttacaaataattctaaagggactactatagataataaaggtacaataagtagtgttaagggagataattctccaacaataagtggaaatagtccaagttctaactcttcaggaggaagttcatcaagtggaggttcttcaggaggaagtagtggaggaagttcttcatcaaaggtaggtcaaataaaatttagtgcaacagataaacaaataaaaatggcatcaggagataagacagtagatccatcagataacacatatatactaaaattaacaaatgggacagtaaaagatggagatgtaaaagctaatgttaaagtagcaggattaccatcaggactagattatacagcagtaggaaatagatcagcaaatacaataacaattacagtatcaggaacagcaagccaatcaatacaaaatgatttaaataatgtaagtgtgctagttaaagcaggagcagtatctggaacaggagctacagattcaattgcaaatacaacatttgaaattaaaaaatatgtggcgccagcaataggtcaattaacttttgatgcaacagataaacaaataaaaatggcatcaggagataagacagtagatccatcagatgacacatatgtactaacattaacaaaaggaacagcaaaagatggagatgtaaaggctaatgttgaagtaacaggattaccatcagggttagattatacagcagaaggagattcatcaacaaatacaataacaataacagtatcaagaacagcaagccaagcagtacaaactgatttagataatgtaagtgtgttagttaaagcaggagcagtatctgaaacaactgccacagattcagcagcaaatgcaacatttgaagttaaaaaatatgtggcagcgccagcagtaggtcaattaacttttgatgcaacagataaacaaataaaaatggcatcaggagataagacagtagacccatcagatgacacatatgtactaacattaacaaaaggaacagcaaaagatggagatataaaggctaatgttgaagtaacaggattaccatcagggttagattatacagcagaaggagattcatcagcaaatacaataacaataacagtatcaggaacagcaagccaagcagtacaaactgatttagataatgtaagtgtgctagttaaagcaggagcagtatctgaaacaactgctacagattcagcagcaaatgcaacatttgaagttaaaaaatatgtggcagcgccagcagtaggtcaattaacttttgatgcaacagataaacaaataaaaatggcatcaggagataagacagtagatccatcagatgacacatatgtactaacattaacaaaaggaacagcaaaagatggagatgtaaaggctaatgttgaagtaacaggattaccatcagggttagattatacagcagaaggagattcatcagcaaatacaataacaataacagtatcaggaacagcaagccaagcagtacaaactgatttagataatgtaagtgtgttagttaaagcaggagcagtatctgaaacaactgctacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaacaggattaccatcagggttagattatacagcagagggagattcatcagcaaatacaataacaataacagtatcaggaacagcaagccaagcagtacaaactgatttagataatgtaagtgtgctagttaaagcaggagcagtatctgaaacaactgccacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaataggattaccatcagggttagattatacagcagaaggagattcatcagcaaatacaataacaataacagtatcaggaacagcaagccaagcagtacaaactgatttagataatgtaagtgtgctagttaaagcaggagcagtatctgaaacaactgctacagattcagcagcaaatgcaacatttgaagttaaaaaatatgtggcaccagcaataggtcaattaacttttgatgcaacagataaacaaataaaaatggcatcaggagataagacagtagacccatcagatgacacatatgtactaacattaacaaaaggaacagcaaaagatggagatgtaaaggctaatgttgaagtaataggattaccatcagggttagattatacagcagaaggagattcatcagcaaatacaataacaataacagtatcaggaacagcaagccaagcagtacaaactgatttagataatataagtgtgttagttaaagcaggagcagtatctgaaacaactgctacagattcagcagcaaatgcaacatttgaagttaaaaaacatgcgtcagatccaatatcaacaataggaaaaatatcttctgggctatcaagtttatttaatatattaaaataa

SEQ ID NO: 131 - protein, 1622 aa, Clostridium difficile
MKIPKKIAAMLTVTMIAGSSTAGIASAQTVATNLTGQERYETAVKISQDGWKNADEVVIVNDSSIADALSATPFAKAKNAPILLTSKDKLNDKTKAEIQRLKAKKVYLIGGTSVLSTNIEKEIKDLKISFERISGAERYQTSLELAKKLDAISDVKKIAVVNGEKGLADAVSVGAPAAQNNMPVILADSKNGTAVADKFIKDAGITQSYVVGGESSISEAVKNKLPNSTRLGGTDRNDTNAKVIKEFYKKTDLKNAYVTKDGMNKQDQLIDALAVGVLGAKNQSPVVLVGKNLSASQKSLVNSKSFDKITKVGGNGNETAFNEMKSLQEVKTVEAKTISELKSAIDKATANDVINFKPTSEVKEAFTIQTDKAVTVNLNGTYTKTVTINMPNGDVNNYAKVDDVVIDDVKDGTFVNYGKITNLKVNDKNGAKIENNSKGEIGSLTVASGASQVKVTNGGKITTVTNNSKGTTIDNKGTISSVKGDNSPTISGNSPSSNSSGGSSSSGGSSGGSSGGSSSSKVGQIKFSATDKQIKMASGDKTVDPSDNTYILKLTNGTVKDGDVKANVKVAGLPSGLDYTAVGNRSANTITITVSGTASQSIQNDLNNVSVLVKAGAVSGTGATDSIANTTFEIKKYVAPAIGQLTFDATDKQIKMASGDKTVDPSDDTYVLTLTKGTAKDGDVKANVEVTGLPSGLDYTAEGDSSTNTITITVSRTASQAVQTDLDNVSVLVKAGAVSETTATDSAANATFEVKKYVAAPAVGQLTFDATDKQIKMASGDKTVDPSDDTYVLTLTKGTAKDGDIKANVEVTGLPSGLDYTAEGDSSANTITITVSGTASQAVQTDLDNVSVLVKAGAVSETTATDSAANATFEVKKYVAAPAVGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVTGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVIGLPSGLDYTAEGDSSANTITITVSGTASQAVQTDLDNVSVLVKAGAVSETTATDSAANATFEVKKYVAPAIGQLTFDATDKQIKMASGDKTVDPSDDTYVLTLTKGTAKDGDVKANVEVIGLPSGLDYTAEGDSSANTITITVSGTASQAVQTDLDNISVLVKAGAVSETTATDSAANATFEVKKHASDPISTIGKISSGLSSLFNILK

SEQ ID NO: 132 - DNA, 2919 bp, Clostridium difficile
atgaagaaaggaaatagaaaggcattattaattagtttaattatgattttaagtatggtggtgtctacaatatatccaactgtatcttatgcttcagaattaggagagaatagtcagattcaaagtggttcaactaattcatcaactggagaggagaaggaaagcgacaataaaaagccagaacagactccagagaaagataaggcaacagataataaaaaaccagaacagaccccagaggaagaaaaaccaacagataataaaaaaccagaacagaccccagaagaagataagtcaacagataataaaaagccagagcaaactccagaaggagaaaagccaatagataataaaaagccagagcagataccagaagaagataagtcaacagataataaaaagtcagaacaagctttagaagatgaaaaaccactagacaataaaaatacagaaaaaactccagaggaagataatctattagaagatgaaaatttattgaaagttttagaagaagaacttaatgaagaaaatgaagactatggatttgttgtaaaaattaataacaatacaatagaaacggaatcaatgaaaaaaatatcatttaatttaacttatactccaacatcaaaaggaatacaagcaggagattcaataacttttaaggtgccagatgtattcaataaagttaatttagattatacaagtgaatgctttgataaaacagaaagtaatggagagtatacacttacatttagagaattacctaatggccaaagtgtaatgcaaggtaaaataggtttggaagcatatgttaaaaaggttgatgaagatactaatgcaaaaatacatattgaaactactggaaaaatagaaagtggaagtggagatatagatgtagaaataaaacctggagataaaacggatgttccagatgctaaaggaacacttaaaaagcttgttgaaggaaaaaaatcaactactgtatttatgccagttaaaaataaagatataaattacagtatacaagtaaatgaaaagcaggaagagttaaaagatattattttgtatgatgagcttcctgaaggattgacattgataaatggttctgtaagtgtagtaacaagtgatggaaaagaagttagtgattttaatattgaacagagtaaaaattctatttcagttaattttggaaatatagataaatcgtatactgttaagtataaggctagaatcagtgacaaaaatgcaaaacatggtaataaatataagaatgtagctaggattgaatctgatggtaagaagatacaagaagatgatgctactgtaagtatatttgatagaggagatgattatcttcttactaaaggacattcaggagcaacaaatattactcaagttggtcaagtaataaactatcagatttcaataaatgatgataaatcaccaataagtaatgttgttataacagataatataccagaaggcatgagattaactacttcaggagaagctgggcatgattttagagttgtagaaattccaatgaatgggagctggactccttggagtaaagaaaaaattgccaataatatttcatataaagtagaagaaaaaagaaatgaaagtgggcaagtagataaagttataactggatttacaattaatctcagtaaagaagaagtggaatcaaagttttttatagcttatacattaaaggtaattagtattgaagatagctatataaatagagctgttcttgatgcaaataatagtgaaattgataaaaatgatgagataaactttaagaaaaattctggattaataagcgcaaaaaaagaagttgataaaaaagttttaaacagtagtgataaccagattgttaaatacaaaatcaatatgtcaacttatggagtttatgatgcaggacaagtaaatcttttagatgaagtaaactcagttctagaaatatctaatataaaatattctgataatcttgaacttaaaaaagaagctggagatggaaaaaatacaataagattagtaaataaatacgaatttaaacagataaaagaaggggaacctgtgcaaagttgggttacatttgatgcaaacttcacaaatgtaaaagttggggagactatacgaaatgtggctcagattaatggttcaagtcctccaggagtagagactactaagcaaggttatgcttttgaagctaaaaaagtggatgctttagataaaaatgtactttcaggtgctaagttcaatttagaagatgcatttggaaatatagtagttaaggatttagtcagtgatgaagatggtataattcaatctagtgtaaaaaacccaggaacatattatttagtggagataatggctccacgtggatatgaaaaactgaaggataaaattaaggttgaaattggtaataaagatattggtagaatagtggatattggaaatatagaaaacataagacaagaaaatccaccagtaaatccaccagcaccaccaaatacagatgaaccaatagtaaatccaccagtaccaccaagcacagataaaccaaggaaaccatcaagttcatctgatacagaggatactatagttataaatccaccagtaccaccatcagaagatataataaatccgccaataccagaggtattgaatcctccagtaccaccatcagaagagatgatagaaactcctgttaaacagattattccaataccagaagtagtaaagccatcagtgtcagaagaaaaaaataataaagttaaagatgatactttggtaaatccaccagtaccaccaaaaacaggggatagtactacaattattggagaaatacttttagttataggagctattgtaggacttatcgtattaagaagaaataaaaatacaaattag

SEQ ID NO: 133 - protein, 972 aa, Clostridium difficile
MKKGNRKALLISLIMILSMVVSTIYPTVSYASELGENSQIQSGSTNSSTGEEKESDNKKPEQTPEKDKATDNKKPEQTPEEEKPTDNKKPEQTPEEDKSTDNKKPEQTPEGEKPIDNKKPEQIPEEDKSTDNKKSEQALEDEKPLDNKNTEKTPEEDNLLEDENLLKVLEEELNEENEDYGFVVKINNNTIETESMKKISFNLTYTPTSKGIQAGDSITFKVPDVFNKVNLDYTSECFDKTESNGEYTLTFRELPNGQSVMQGKIGLEAYVKKVDEDTNAKIHIETTGKIESGSGDIDVEIKPGDKTDVPDAKGTLKKLVEGKKSTTVFMPVKNKDINYSIQVNEKQEELKDIILYDELPEGLTLINGSVSVVTSDGKEVSDFNIEQSKNSISVNFGNIDKSYTVKYKARISDKNAKHGNKYKNVARIESDGKKIQEDDATVSIFDRGDDYLLTKGHSGATNITQVGQVINYQISINDDKSPISNVVITDNIPEGMRLTTSGEAGHDFRVVEIPMNGSWTPWSKEKIANNISYKVEEKRNESGQVDKVITGFTINLSKEEVESKFFIAYTLKVISIEDSYINRAVLDANNSEIDKNDEINFKKNSGLISAKKEVDKKVLNSSDNQIVKYKINMSTYGVYDAGQVNLLDEVNSVLEISNIKYSDNLELKKEAGDGKNTIRLVNKYEFKQIKEGEPVQSWVTFDANFTNVKVGETIRNVAQINGSSPPGVETTKQGYAFEAKKVDALDKNVLSGAKFNLEDAFGNIVVKDLVSDEDGIIQSSVKNPGTYYLVEIMAPRGYEKLKDKIKVEIGNKDIGRIVDIGNIENIRQENPPVNPPAPPNTDEPIVNPPVPPSTDKPRKPSSSSDTEDTIVINPPVPPSEDIINPPIPEVLNPPVPPSEEMIETPVKQIIPIPEVVKPSVSEEKNNKVKDDTLVNPPVPPKTGDSTTIIGEILLVIGAIVGLIVLRRNKNTN

SEQ ID NO: 134 - DNA, 894 bp, Clostridium difficile
tgttcaatggaaggaccaagtaaatcagataataaaggtggttcagacaagaaagatttaactattggagtatctacaataactcttcaacatcaattttttatagatattgatgagggaataaaagaaaaagctaaagaattaggtgtgaaagttatagtaaatgacccagaccaagatgtagctaagcaaacatcagcaatagaagattttatacaacaaaatgtagatggaatgatagtacttggaactgataattcggctatagtaccagcagtagaaggagcatttgaaaaaatgccagtagttacagtagatgctgtattaaatactgaaaatattacaagttatgtaggaacagttagttatgatgctggtaaaaaattaggggaatacactaaaaaatacatagatgaaaagttaggtggaaagtcagaaatagcaatagtgacagatttaaaatctcaaatacaaatgcagagaatagatggatttaaagatgcattaaaaggttcagcaaatgttaagatattaaattcacaaccaggatatgacagagaagaatctcttaatacagtagaaaacttaattcaatctaatccagatgtagatataatatatgcaacagctgaaaatagtgtactaggagctaaagctgcacttgaatctgcaaaaaataaggatgttaagattgtaggatttgacttaactgaagaagcatcaagtggaataacagatggaactattcttgctatgattcaacaacaacctaaagagatgggacgtttagctgtagaagcagtagtaaaagctataaaaggggaaaaggtagaaaagaatataccagtaccagctttactttatgataaggaaaatataaaagactttaagaat

SEQ ID NO: 135 - protein, 298 aa, Clostridium difficile
CSMEGPSKSDNKGGSDKKDLTIGVSTITLQHQFFIDIDEGIKEKAKELGVKVIVNDPDQDVAKQTSAIEDFIQQNVDGMIVLGTDNSAIVPAVEGAFEKMPVVTVDAVLNTENITSYVGTVSYDAGKKLGEYTKKYIDEKLGGKSEIAIVTDLKSQIQMQRIDGFKDALKGSANVKILNSQPGYDREESLNTVENLIQSNPDVDIIYATAENSVLGAKAALESAKNKDVKIVGFDLTEEASSGITDGTILAMIQQQPKEMGRLAVEAVVKAIKGEKVEKNIPVPALLYDKENIKDFKN

SEQ ID NO: 136 - DNA, 723 bp, Clostridium difficile
ccagcattgtttagaaatatagaaaaaagtaaagcagttacatgtctttctaatagagaaaatataaagactcaaattgttattgcaatggctgaggaatcaagtaagggcaagaatgaagtcatgaaagaggtattagaaaacaaagatggtaagtactttgaaacagaaccaaagtgtaagtcaggtggaatatattcagcaacgtttgatgatggttatgatggaataactggaatagaaagcattgcaaaagtgtatgttacttgtacaaaacatccagatggtgttgaaatggctagggatatacatcaaagtatgaaagatttgattgcatcattttcacaagacccttctataataccaggagcctcaaagggtaatgatgattttagaaaatatttattagacaataaatataaaaatgggtggcctacaattccagatgaatttaaggcaaaatatggattaagtaaggatacactatatatacaaccatatgcatatagtcctactaaatctgatgctactgtagttgtatttgcaaataataagactgggggtaattggtatacttccctagtttacgattatgatgaaggtagatggtataaaggtaaaaatggtatttctgttgcaggtaggtcatgggatgttgacacagatagtgttaagtctgtaaaaacagagattcattctaaagagggatggggtcctttaaat

SEQ ID NO: 137 - protein, 241 aa, Clostridium difficile
PALFRNIEKSKAVTCLSNRENIKTQIVIAMAEESSKGKNEVMKEVLENKDGKYFETEPKCKSGGIYSATFDDGYDGITGIESIAKVYVTCTKHPDGVEMARDIHQSMKDLIASFSQDPSIIPGASKGNDDFRKYLLDNKYKNGWPTIPDEFKAKYGLSKDTLYIQPYAYSPTKSDATVVVFANNKTGGNWYTSLVYDYDEGRWYKGKNGISVAGRSWDVDTDSVKSVKTEIHSKEGWGPLN

SEQ ID NO: 138 - DNA, 858 bp, Clostridium difficile
ctagataagattgaaaatattcaaggagtagataaatatgaaacagctgggcttatttcagataagcaagattttacaacagcagttcttatcaatgcagactctacaatggtagatggaattgctgcaagtggtcttgcaggagtaaataatgcagctattttattaactaataaggatgatataccagaagcaacgcttcaaagactgaatagagttactaagatatatgtaataggtggagaaaattctataagtaaagatgtagaaaaaatgttacttatgagaagaatgcaagttataagaattgatggtgtagatagagtagatacaagttataaaattgcaggcgaaatagaaaaaattaaaaacagtgataagatgtttttagtaaatggatttaaggatgaagctgatgcagtaagtgttgcatctgttgcttatagagatggagctcctataatattgacaaaagatataccttcagcagaagaagacacagacttagacccatggtttggagtttctcctgttccagtatatgctattggaggagagtctacattaagtgattacatagtgagcagatatagagcaactagaattggcggtgttgatagatatcaaactaataaaaatgttattgaaaagttctataatggagcaaaagagttctatataacaagtggagacgatttagtttatgctttagttgcatcaccacttgcaaaaaatgctcctgttgttttagtttcaaataaaagtgataagagtatattaagtggagctagtaaagtaacagcaataggtataagtgataagagtattatagagcaatgtttggatgctgtaaagaag

SEQ ID NO: 139 - protein, 286 aa, Clostridium difficile
LDKIENIQGVDKYETAGLISDKQDFTTAVLINADSTMVDGIAASGLAGVNNAAILLTNKDDIPEATLQRLNRVTKIYVIGGENSISKDVEKMLLMRRMQVIRIDGVDRVDTSYKIAGEIEKIKNSDKMFLVNGFKDEADAVSVASVAYRDGAPIILTKDIPSAEEDTDLDPWFGVSPVPVYAIGGESTLSDYIVSRYRATRIGGVDRYQTNKNVIEKFYNGAKEFYITSGDDLVYALVASPLAKNAPVVLVSNKSDKSILSGASKVTAIGISDKSIIEQCLDAVKK

SEQ ID NO: 140 - DNA, 933 bp, Clostridium difficile
tgttcaccaggaaaagataaccctaaaaataaggagctatcagttgtcaaacaagtaaaagtagctgttccagatggactaccagcagtggcaatagctaaacttgcaaatgaaaatccagagattaaagaaggatatgaaacagtgtatagcattgaaaagacacctgaggcgatttccactagagtgatgaaaaaagatgcagatatagctatagttccttcaaacatggctgcaatagcgtataataaaacttcatcatataatattgttggaactgtaggaatgggttcactttatttggtgtcaacagaaaatataaaagattactctgatttagttggtaaagaagttggatgtactggaaaaggacttactccagacataactataaaaagtcttttgttacaaaaggatataaattattcagatataaaatttaattatgtaagttcagcaagtgaactggtaccattattggctactggtaaagttaaaacaggtattgttccagaacctgcacttagtgctttgatgtctaaaaatccagacataaaaattataaaaagtttaaatgactcatggaaggaagtaagtggttcaaaagacggttatcctcaatctactttaattgtaaagtctgaatttttaagagataataaagattttgttgattcttttgtaggtcaattatcaaatagtatagattgggcaaacaaaaatcctgaagaattaggtgcatattctgaaaaaataaaaatatctactgaatcaaagataataggaaaatctcttgaaagagctaatttgaaatatattccagttaaggacatgattaaagattataaaaattactatgagaaattagctaattttgatgataagacattaggaggcaaagtaccagatgaagcaatatactttgttgagaaa

SEQ ID NO: 141 - protein, 332 aa, Clostridium difficile
CSPGKDNPKNKELSVVKQVKVAVPDGLPAVAIAKLANENPEIKEGYETVYSIEKTPEAISTRVMKKDADIAIVPSNMAAIAYNKTSSYNIVGTVGMGSLYLVSTENIKDYSDLVGKEVGCTGKGLTPDITIKSLLLQKDINYSDIKFNYVSSASELVPLLATGKVKTGIVPEPALSALMSKNPDIKIIKSLNDSWKEVSGSKDGYPQSTLIVKSEFLRDNKDFVDSFVGQLSNSIDWANKNPEELGAYSTGTTCACCAGGAAAAGATAACEKIKISTESKIIGKSLERANLKYIPVKDMIKDYKNYYEKLANFDDKTLGGKVPDEAIYFVEK

SEQ ID NO: 142 - DNA, 1200 bp, Clostridium difficile
cttgaaaagggaacagtaacagcaagtgccttgaatataagaagtggaccaagttctgattgcgataaggtagcaaaattatacaagggaaaaactgtagagattttagaaaagtctaatggatggtataaagtaagggtatcgagttctgttgttggatggggaagtgcaaaatacatatcaacaagtggttcgtctgaaggtacatcaagtcaaaataattcaacttcaagtgggacaactattagtggaaatggtaaagtaaatgtgagttctagactgaatgtaagaagtggtgcaggtactaactattcattagttggtaaagcaaataatggagatgtagtaaagttactagaacaaagcaatggatggtataaaataaaactatcaaatggagttactggatgggctagtagccaatatatctctaaaacatcagaggatgttggaacgaataattctagtaattcaaatagtactaataattctgataaaaaaccatctagcgaagaatcaattgaaggcaagaatggtaaggtaacatctgctgtgagtttaaatgtaagaagtggtcctgggacaagctattctataataggaaaattaaatggtggagatgttgttgaattaaaagctaaaagtaatggttggtataaggtaaagttatcgagtggaacaattggatgggtgagtgccagttatatttctgagactaatgaggatacaaaagaaaaaccaaattcatcatctaaccaaaattctcaatctaatagtaactcaaagccatcatttactggaaattcagataaatctacagcaaaaggttcaacaatcgtagattttgcatatactcttattggaataccatatcaatggggagcttcaggacctgataaatttgactgttctggatttacacagtatgtttttaaacattctgtaggcgtttctattcctagagtttctagagaacaggctaattttggaagtgcaatttctatggggaattatgcaccaggagatttagtttattttgacactgatggtgatggaacaactaatcatgtaggtatatatgtaggaaatagtaaatttatccattgtagtggtactcagactaatcctaataaggttaaagtggataatttaactagttcatattggtctaaagtattacttggtgcaagaagatttgtt

SEQ ID NO: 143 - protein, 400 aa, Clostridium difficile
LEKGTVTASALNIRSGPSSDCDKVAKLYKGKTVEILEKSNGWYKVRVSSSVVGWGSAKYISTSGSSEGTSSQNNSTSSGTTISGNGKVNVSSRLNVRSGAGTNYSLVGKANNGDVVKLLEQSNGWYKIKLSNGVTGWASSQYISKTSEDVGTNNSSNSNSTNNSDKKPSSEESIEGKNGKVTSAVSLNVRSGPGTSYSIIGKLNGGDVVELKAKSNGWYKVKLSSGTIGWVSASYISETNEDTKEKPNSSSNQNSQSNSNSKPSFTGNSDKSTAKGSTIVDFAYTLIGIPYQWGASGPDKFDCSGFTQYVFKHSVGVSIPRVSREQANFGSAISMGNYAPGDLVYFDTDGDGTTNHVGIYVGNSKFIHCSGTQTNPNKVKVDNLTSSYWSKVLLGARRFV

SEQ ID NO: 144 - DNA, 741 bp, Clostridium difficile
tgttcatcaggaaataataaaaataaagaagaacaaaaagttataagagttgcaacatcaggaacatattacccttttgcttttaaagataaagataaacttaaagggtttgaagtagatttttgggatgaatttgctaaacgaactaattgtaaagttgaatgggtattaactgattttagtggattatttggattattagaagctgataaagcagatgctgtatctgctcaacttactgcaacacctgaaagagagaaaaaatatgctttttcagatgcttataattatagtggaacaaacattattgttagagaagatgatactagtataaaatcaatagatgatttagttggcaagaaagtaggtgtgggtactggagcagtagcaaatgaaatattaaaagaaaaatacccaaatgatgaaataaaaatagtaaattattcaagtgcgactcttaaagggaattatcaagacctagaaatgggaagattagatgcagtagttgcgcaggatgttgaggctttaatagctataaaagaacaaaaattaaatcttaaaatgatagaacctccaattcaatttggtgcctgttcttttgcgcttcaaaaaaatgaaaaaggtgaaaaatggacaaaagaaattaacgaagtaattgaagagatgtataaagatgggactttgactaaaatatctgaaaactggctaggaaaagacattactaaggagcctattaatgag

SEQ ID NO: 145 - protein, 247 aa, Clostridium difficile
CSSGNNKNKEEQKVIRVATSGTYYPFAFKDKDKLKGFEVDFWDEFAKRTNCKVEWVLTDFSGLFGLLEADKADAVSAQLTATPEREKKYAFSDAYNYSGTNIIVREDDTSIKSIDDLVGKKVGVGTGAVANEILKEKYPNDEIKIVNYSSATLKGNYQDLEMGRLDAVVAQDVEALIAIKEQKLNLKMIEPPIQFGACSFALQKNEKGEKWTKEINEVIEEMYKDGTLTKISENWLGKDITKEPINE

SEQ ID NO: 146 - DNA, 1617 bp, Clostridium difficile; identical to SEQ ID NO: 86

SEQ ID NO: 147 - protein, 539 aa, Clostridium difficile; identical to SEQ ID NO: 87

SEQ ID NO: 148 - DNA, 1776 bp, Clostridium difficile; identical to SEQ ID NO: 88

SEQ ID NO: 149 - protein, 592 aa, Clostridium difficile; identical to SEQ ID NO: 89

SEQ ID NO: 150 - DNA, 1020 bp, Clostridium difficile
tgtagtagtaaaccaaaagaaaaagaagaagcaaaaactggaaaagatgattatacaataacagtaggttattataattgtgaccatatgactgcgggaccagtagcagaatcggcaggaatatataaagatttaggtcttaatgtaaaaactgttggaaatggtaaagttcctgaagctatggcagcaggaaaaatggatgcaggttacataggaactaaggggttagttggagcaatacctaagggttcgccaataacaatagcagctaacaaccatactggtggttctgaatatttaatagtttcaaaagatataaaagaacctaaagatttaataggtaaaaaaattgcaacagatatgagtgatttcttatggacaagtgattatggtccagaaacaggtctaccaactgacccatcaaaatatgaagttgtaaatatggattcagacaaagataaatatttagctcttaaaactgggaaaattcaagcttttacatcttgtgacccttggggttctgtagctgaaaatgacggtgcaggaaaaataatagcatctactcaatataaagaaaaagctaatggcaaagaatataactgttgttcattctcattaaacaaaaactttataaaagaacatccagatttagcaaaaaaattggttctagcacatacaaaagcaatagaatatatatatacaaatccagctgaagcagctaaaatatttgcaaaatattataatgtagaagaagaagttgcacttagaactatctataagaagactgttggagaaggtagaactcttacttggaaagttacaggtgaagaatataaaaataatttacaaatgtataaagatttaaaggctttagatgatatacctaaatatgaagatacgattgatacaagcttattggactcttgtggagctgatgattttgacaaatttataaaagaaaaagttaacccagagtttcctgaaggtatgagttatgaagactggaaagcaaaggtatta

SEQ ID NO: 151 - protein, 340 aa, Clostridium difficile
CSSKPKEKEEAKTGKDDYTITVGYYNCDHMTAGPVAESAGIYKDLGLNVKTVGNGKVPEAMAAGKMDAGYIGTKGLVGAIPKGSPITIAANNHTGGSEYLIVSKDIKEPKDLIGKKIATDMSDFLWTSDYGPETGLPTDPSKYEVVNMDSDKDKYLALKTGKIQAFTSCDPWGSVAENDGAGKIIASTQYKEKANGKEYNCCSFSLNKNFIKEHPDLAKKLVLAHTKAIEYIYTNPAEAAKIFAKYYNVEEEVALRTIYKKTVGEGRTLTWKVTGEEYKNNLQMYKDLKALDDIPKYEDTIDTSLLDSCGADDFDKFIKEKVNPEFPEGMSYEDWKAKVL

SEQ ID NO: 152 - DNA, 1203 bp, Clostridium difficile
tgttcaaaaaaagaagattctaaaggcaaagagggtaaagaaaaattagttgtatggtctgcaccattaacagaccatgatgcagatgcatggaagccgatatttgaaaaatttgaaaaagaaaataactgtgaaattgaatttcagatagtaccatgggataactacgcagaaaaatatgcaacagcaataagtgcaggtgaaggtccagatataggatacatgtatgcagagatgtttcctcaatttatagaaatgggtgcggtagaagatttaacaccttatttagaaaaatcaggaacttcagataattatctatacttagatgatgcaaaaatgatgggtggtatttatggtttacctatagaagctgctaatccaggcgtattgtactacaataaagatatactagaaaaattaggagaaaaacctccaaaaacatgggatgattttaaaagaatctgtgaaaaagcaacaaaagatactgatggagatggaaaaatcgaccagtggggtcttgcacaaggttggggttctaaagtatttggaagcttaaactggaactggtatccgtatttatggcaagctggtggagatatatataatgatgatttaaaatcagttaaatttaataatgcagaaggcttgaaagctgcaaactttataaatgatatgaaaaagtatattccagaagatgctttatcaaaagatagtaatgaaatgattgaaagtgtatttggaccaggaaaagctgcatttactataatgctatcctctgctgctacaagtacttttgataaatcattcccggatttaaactggggatatgtaacatcattagaagataagacagttggaagttttgcttcagtagatgatttaacattaatgtcagcatgtaaaaataaagaacttggatttaaacttcttgagtatatgctaagcaaagaatcaatggaagctttccacaaagaaatacctagagctccagttgctaaaggtgaaaaataccaaggagacccaagatttgaagaaatggtgacaagagataaacatatgtatagaccattgacagttggacctcatggagtagagatatatgaatatttatggaaacaacttcaaatgatgatagctggagacataactccagaacaagcactaaatgaatctgcaaaatatgcaaatggattactagcacaa

SEQ ID NO: 153 - protein, 401 aa, Clostridium difficile
CSKKEDSKGKEGKEKLVVWSAPLTDHDADAWKPIFEKFEKENNCEIEFQIVPWDNYAEKYATAISAGEGPDIGYMYAEMFPQFIEMGAVEDLTPYLEKSGTSDNYLYLDDAKMMGGIYGLPIEAANPGVLYYNKDILEKLGEKPPKTWDDFKRICEKATKDTDGDGKIDQWGLAQGWGSKVFGSLNWNWYPYLWQAGGDIYNDDLKSVKFNNAEGLKAANFINDMKKYIPEDALSKDSNEMIESVFGPGKAAFTIMLSSAATSTFDKSFPDLNWGYVTSLEDKTVGSFASVDDLTLMSACKNKELGFKLLEYMLSKESMEAFHKEIPRAPVAKGEKYQGDPRFEEMVTRDKHMYRPLTVGPHGVEIYEYLWKQLQMMIAGDITPEQALNESAKYANGLLAQ

SEQ ID NO: 154 - DNA, 885 bp, Clostridium difficile
aatcccaaaagagagttgatagaagggagtataccagagatttcgacagaattaaataaaagagcatttaaggattctaaagaagtaattcttgtaaatgaagagtcaattgtagatagtataagtgcaacacctttagcatattcaaaaaatgctccaatagttgtaactaagagtaaaaatcttggtagagtaacaagaaattatctaaaagaactaggtccagagaaggttacgatagtaggtggtttaaaggcagtatctaaagatgctgaacgtaatatagaaaaaatgggaatgaaagtagaaagaataagagggaaagacagatatgatacatctttaaagatagctagagaaatgtatagaacagtaggatttgatgaagcatttttacttagctcaacaacaggattagagaacgccatatctgtatattcttatgccgctaaaagtggaatgccaataatatgggctaaagatgaagggtttgaggaacaaattgatttcttaaaaggcaagaatcttaaaaaaatatatgcattaggtgattcaaaagaatttattgcagagattgattctaacttaaaaaatatagaaggaataaagcaaataaataagtcaagtacaaatgttgatttaataaagaagttttatgatgaaaaagatataaagaaaatctatactgctagattagactttggtagtagatctgatgtaaacgaatatatttctttgggagtagtatcagcaaaagaaaatatgccaatactgatttgtagtgataacttaagtcgtgcacaagataaattcttgaaagatagcaatataaatgatgtagttgaagttgggtatacagtaggtgattatagtctatttaagagc

SEQ ID NO: 155 - protein, 295 aa, Clostridium difficile
NPKRELIEGSIPEISTELNKRAFKDSKEVILVNEESIVDSISATPLAYSKNAPIVVTKSKNLGRVTRNYLKELGPEKVTIVGGLKAVSKDAERNIEKMGMKVERIRGKDRYDTSLKIAREMYRTVGFDEAFLLSSTTGLENAISVYSYAAKSGMPIIWAKDEGFEEQIDFLKGKNLKKIYALGDSKEFIAEIDSNLKNIEGIKQINKSSTNVDLIKKFYDEKDIKKIYTARLDFGSRSDVNEYISLGVVSAKENMPILICSDNLSRAQDKFLKDSNINDVVEVGYTVGDYSLFKS

SEQ ID NO: 156 - DNA, 1641 bp, Clostridium difficile; identical to SEQ ID NO: 96

SEQ ID NO: 157 - protein, 547 aa, Clostridium difficile; identical to SEQ ID NO: 97

SEQ ID NO: 158 - DNA, 1248 bp, Clostridium difficile; identical to SEQ ID NO: 98

SEQ ID NO: 159 - protein, 416 aa, Clostridium difficile; identical to SEQ ID NO: 99

SEQ ID NO: 160 - DNA, 1413 bp, Clostridium difficile; identical to SEQ ID NO: 100

SEQ ID NO: 161 - protein, 471 aa, Clostridium difficile; identical to SEQ ID NO: 101

SEQ ID NO: 162 - DNA, 3306 bp, Clostridium difficile; identical to SEQ ID NO: 102

SEQ ID NO: 163 - protein, 1102 aa, Clostridium difficile; identical to SEQ ID NO: 103

SEQ ID NO: 164 - DNA, 1941 bp, Clostridium difficile
actgaatctaatgctatggaaaataacgctgatttaaatataaacttagagaaaaaaagtatcgttttaggtagtacctcaaaagtcagtgttaagtttaaagaaaaaccagatgcagatagcattacattaaagtataaatgctatgatatgccattggatacaactttaaactacaatcaatcaactgagtcatatgaaggaactatcaattataataaagacccagaatatctaaatgtttgggaactacaagggataacaataaacagcaaaaataatcctaaaactttaaacaaacaagaactagaaaagatgggattaaatttaaaagactataatgtaacacaggaatgtataattgaagatataacttctagaaaagatgtaaataaatatttaagaaaaacttctgcacctattacagaacttacaggaagtgatagatacgaaacagcagttaaaataagtaaagaaggctggaaaaatggttcagataaggtagttataataaatggggatgtaagtatagatggcattatatcaactccactagcaactacatataatgctccaatacttttggttgaaaaaaacaatgtacctaatagtgtaaaatcagaattaaagcgtttaaatcctagagatgtaattataattggagatgagaatgctatttctaaaactactgctaatcaaattaaatcgactgtaaatgctagtcaaacacgtctaaagggctctaatagatatgagacatctttattgatagcaaaggaaatagataaaaatcatgatgtggaaaaagtatacataacaaatgctaatggcggagaagtggatgcacttactatagcagcaaaagcaggtcaagacaagcaaccaattatattaactgataaaaatagtattacagacaatacatataaatggttaaagagtgaggatttacaaaatgcttattttataggtggccctcaaatgatatcaacaaatgttataaataaggtaaatgatataactaaagataatgttactaataatagagtatatggagcagatagacacgaaacaaatgcaaacgtaataaaaaaattctatacagatgatgagttagaggctgttttagtagctaaatcagatgtacttgttgatgctttagcagcaggtccattggctgcgaacttaaaatctccaatacttataacaccaaagacatatgtatctgcataccataaagaaaacttagaagctaaatcggcaaataaggtatataaaataggtggaggattgacttctaaggtaatgagctctatagcatcatcattatctaaacacaatacgactccaacagaaccaggaaatagtgggggcaagacagttatgattgacccaggacatggtggttcggacactggaacaacaggtaaaccattagggggtattagagaaaaagactatacattaaatacttcacttgcgacaactgaatatttacgttcaaagggattcaatgtaataatgacaagagacacagataagactttatctcttggaaatagaactgctttatctaactctttgagaccagatttatttacgagtatacactataatgcatctgatacaactgggaatggtgtagaagtattttataagcttaaagataaagatggaggaactactaagactgtagctacaaatatattaaatagaattttagagaaatttaatctaaaaaatagaggtgcaaaaacaagaacactatcaactgaccctacaaaagattatttatatgttttaagaaataatgatatgccagctgtacttgtagaatgtgcatttttggataatgagaaagatatgagtttacttaatacatcaaataaagtaaaagaaatgggtacacaaataggtaaaggcatagaagattcattaaaa

SEQ ID NO: 165 - protein, 647 aa, Clostridium difficile
TESNAMENNADLNINLEKKSIVLGSTSKVSVKFKEKPDADSITLKYKCYDMPLDTTLNYNQSTESYEGTINYNKDPEYLNVWELQGITINSKNNPKTLNKQELEKMGLNLKDYNVTQECIIEDITSRKDVNKYLRKTSAPITELTGSDRYETAVKISKEGWKNGSDKVVIINGDVSIDGIISTPLATTYNAPILLVEKNNVPNSVKSELKRLNPRDVIIIGDENAISKTTANQIKSTVNASQTRLKGSNRYETSLLIAKEIDKNHDVEKVYITNANGGEVDALTIAAKAGQDKQPIILTDKNSITDNTYKWLKSEDLQNAYFIGGPQMISTNVINKVNDITKDNVTNNRVYGADRHETNANVIKKFYTDDELEAVLVAKSDVLVDALAAGPLAANLKSPILITPKTYVSAYHKENLEAKSANKVYKIGGGLTSKVMSSIASSLSKHNTTPTEPGNSGGKTVMIDPGHGGSDTGTTGKPLGGIREKDYTLNTSLATTEYLRSKGFNVIMTRDTDKTLSLGNRTALSNSLRPDLFTSIHYNASDTTGNGVEVFYKLKDKDGGTTKTVATNILNRILEKFNLKNRGAKTRTLSTDPTKDYLYVLRNNDMPAVLVECAFLDNEKDMSLLNTSNKVKEMGTQIGKGIEDSLK

SEQ ID NO: 166 - DNA, 1656 bp, Clostridium difficile
tgtagtaatactaaaacaaaacaaagtagtagtgattcaagtttacaaagtcaaagttcgatagatgctaagtatataaacttaacaatggtaactccaaaaactataaatcctataactaatactgataagtctgttggttatataatgaatttagtttatgatagtttatttactatagatgagaactacaatgtaattcctcaattagttaaggagtataatatagctcaggatggaatgagtatagatataaagctaaaagatgcaaagtggcatgatggaaaaaatgttacttcaaatgatgtaaactatactattggtttaattcaaaaaagtgcagatagtccatataatgaatttactaaaaatatagcttctgtgaatattaaatcagataaagattttacaataaaatttaaagctagatatgctttttcaattgatagtttaatttttccaattgtatctcaaaatcatttagattcaaaagatgtaaatgacaagaataataatatgataggaaatgggaaatataaaatagaatcatatacagaaagagaaggaatggttttatctgtaaacaaagattactatgaagaagttccaaaaaccatgaagaacataaaagtaggtatggtgcctaatgaagatgcaaggacatctatggttatggctcttgatagtgatataaccaatgttacattaaatgatttaagtaagtttcaagaaaaagagtttaatataacaaaatatcaaggaagagattatgagtgtgtattatttaattataataatccttttttcaaagatgttaattttagaaaagcaattgcacactctatagataaagatagaattattagtgaaggttatatggatgatgctactccagttaattttccacttaattcaaaatcaaaatactataatagtgaaatgaaggatttagagtttaataaagataaggcgatagagtgtcttgctaaggtagaatatgcaaatgtaaactcagtaaatcaaaatgacaataaagtaaaaaatcagaaaaaatcagctaaaaagaactcaaagaagcttacgccagaagaagaagcaaaagctaaaaaagcagaagaagatagaatcaaaaaagaagctgaagagaaaaaaaatagagaaaaagaggaagtaaagaaaagtctttctgaaatgaacttaaagataatagtaaacagagataatagtgagagaataaaaactgcaaacataataaatgaaaacttaaaagctataggaataaatagtacagtaaatcagctgtcagataaggatatggaaaatgctcttaattctaaaaattatgatttagcattagttggatggaaactatcaattataccagatgcaagtagtattatagcgagtagtggatatactgatgataagttaaatggatatatgtctgcacttacaagttctacgtctgaaattgaaacaaaaaaagcatacaaagatgtacagacatatataaaagataatgcaacatttataagtttagctgtgagaaacaactatattgtaagtaatagtagattaaaaggtaaaattactccaaatgattttgatgtatatgagggaatatctaatttagatataaaatcgaatgaatcaaat

SEQ ID NO: 167 - protein, 552 aa, Clostridium difficile
CSNTKTKQSSSDSSLQSQSSIDAKYINLTMVTPKTINPITNTDKSVGYIMNLVYDSLFTIDENYNVIPQLVKEYNIAQDGMSIDIKLKDAKWHDGKNVTSNDVNYTIGLIQKSADSPYNEFTKNIASVNIKSDKDFTIKFKARYAFSIDSLIFPIVSQNHLDSKDVNDKNNNMIGNGKYKIESYTEREGMVLSVNKDYYEEVPKTMKNIKVGMVPNEDARTSMVMALDSDITNVTLNDLSKFQEKEFNITKYQGRDYECVLFNYNNPFFKDVNFRKAIAHSIDKDRIISEGYMDDATPVNFPLNSKSKYYNSEMKDLEFNKDKAIECLAKVEYANVNSVNQNDNKVKNQKKSAKKNSKKLTPEEEAKAKKAEEDRIKKEAEEKKNREKEEVKKSLSEMNLKIIVNRDNSERIKTANIINENLKAIGINSTVNQLSDKDMENALNSKNYDLALVGWKLSIIPDASSIIASSGYTDDKLNGYMSALTSSTSEIETKKAYKDVQTYIKDNATFISLAVRNNYIVSNSRLKGKITPNDFDVYEGISNLDIKSNESN

SEQ ID NO: 168 - DNA, 1293 bp, Clostridium difficile
cttgaaacaatttatactattcaaggaaaagataaatacgaaacggctgctcttatagctgatgaacaaaattatactacagctatattaattaatgcagacagcacaatggctgatggattaagtgcgagtggacttgcaggagcaacaaatgcaccaatttttttaactaagaaaaataacatacctaatgcaactcttaaaagagtagagaaagctaaaaaggtatacataataggtggagaaagttctattgataaagcaacagaaactcttctaaaagataaaggaatagaggctaaaagacttcaaggtagtgatagaattaagacaagctataatgttgcaaaagaaataaactcaattaacaaagtaaataaagttatattgactaatgcttttaaaggagagcctgatgcaatgagtgctgcacctgtagcagttagagataaagcagctatagtattaactgatggaaaaagtgttccatttaatacaactggtgtagaaagttatgtaataggtggtacttcatcaatgagtgacaaactagttaatgatactaattcaactagattaggtggagtagatagatatgatactaataaaaaaatagtaaataagttctataatggcgcaaaagaattttatatagctagtggtactgatttagtttatgctttagttgcttcaccaatggctaaaaataatcctattgtactagttgatattggaagtaataaagatatacttaaaaatgctgcaaaagtgactgggataggaaatctaagtgataaaattatgctagagtgtgaaaataccatcaataatattagtcttccatcttcaaataaaaatataatatgtggattaaagattgattttgattcaaatcacataatttggcaagataaaggaagttatcttgaatgttatgatgataaccttgaatattatactgaaaaatataaagacccaacagttcctataaatatagaaaatacaagtacgcaaaatttagatgtaacaaaattaaaagtttatggagaagctaattcaacattatatatggggcaatacgctaaaataaaaatggattttaatagttttggtgtattaaagccaggagaaaaatgtactatttatttagatataatttcattagatccatcaagaagcatgacattaacattttcttatgtaggtgataaagaaaattataaatatgaacaaggattggtaagtagaatattattttataacccagatggagaagatttttttgaatataaa

SEQ ID NO: 169 - protein, 431 aa, Clostridium difficile
LETIYTIQGKDKYETAALIADEQNYTTAILINADSTMADGLSASGLAGATNAPIFLTKKNNIPNATLKRVEKAKKVYIIGGESSIDKATETLLKDKGIEAKRLQGSDRIKTSYNVAKEINSINKVNKVILTNAFKGEPDAMSAAPVAVRDKAAIVLTDGKSVPFNTTGVESYVIGGTSSMSDKLVNDTNSTRLGGVDRYDTNKKIVNKFYNGAKEFYIASGTDLVYALVASPMAKNNPIVLVDIGSNKDILKNAAKVTGIGNLSDKIMLECENTINNISLPSSNKNIICGLKIDFDSNHIIWQDKGSYLECYDDNLEYYTEKYKDPTVPINIENTSTQNLDVTKLKVYGEANSTLYMGQYAKIKMDFNSFGVLKPGEKCTIYLDIISLDPSRSMTLTFSYVGDKENYKYEQGLVSRILFYNPDGEDFFEYK

SEQ ID NO: 170 - DNA, 1347 bp, Clostridium difficile; identical to SEQ ID NO: 110

SEQ ID NO: 171 - protein, 449 aa, Clostridium difficile; identical to SEQ ID NO: 111

SEQ ID NO: 172 - DNA, 1374 bp, Clostridium difficile; identical to SEQ ID NO: 112

SEQ ID NO: 173 - protein, 458 aa, Clostridium difficile; identical to SEQ ID NO: 113

SEQ ID NO: 174 - DNA, 2442 bp, Clostridium difficile
tcaaatactttcgcagatactatagaagaaagtactaatgcaggaaatgcagaaggagatactaatgcaggaaatgcaggaggggatgctaatgcaggaaatgcaggaggggatgctaatgcaggaaatgcaggaggggatgctaatgcaggaaatgcaggaggggatgctaatgcaggaaatgcagaagaagattctaatgcaggaaatgcagaaggagatgctaatgcaggaaatgcagaagaagatgctaatgcaggaaatgcagaagaagattctaatgcaggaaatgcagaagaagatatgaatgcattagttgtggaagaagccactgcagaagatcctacatctgtaggagactttaaaattagtggtggagaaataaatgtcgattttaaatttgcaagtggcgttttaactattcttagtggaaaacaaatgacaattcaaaataataatccaaatactccaacaacacataggattgttatacctaaagatgtaaaagctgaattaatatttgatggagtaaatattaaaactgcatctaatagcccatttactttaacaccagataaagatggtggtgcatatgcacatgttatattacaagatggtagtgaaaacaagctagagtcaggtgatgtatattatccaggtatgagagcaggaaaaggtactactctaactattgatgattctgttgtaaatagagatattgaaggagagtttatagttcctgagggtggaaaaattcctagagatgtaactctagaaaatggagacaagttaaaaaaaggagatcgccttacactactagatagtaataatagaggaagtttaaaagttgttggaaattattattctgcaggtattggcggtggaaatactgaaagtggaggaaatattattattaatggtggtgctataactgctataggtcaagaatcgagtcgtaatacaggatatggagctggaataggtggaggcggtaatggtagtggtggagatatcacaatcaatggtggtactataactgctaaaggtgcataccatggagctggaataggtggaggatactatacaacaacaaagaatgcattaagtccctcagtagtagatcctagcacaggttctggttatagtggaaatattacaattaatggtggactttcctattcatatggaggtgcacatggtagtgcatttggggatggatgtgttaatccaggaacaaatagaggatatcgtatacttgtaactggaggaacgattttaccttatatgacaggagtgggagattggatttttgacctaagtgctacaacaggagatgttatagtaacaggtggttcattaaaagcaacaacattcaaaagtttaggtggagcagttgcatacggtgatttagaaaagaaaacaaaagtttttatgaataaaatatctttaaagtatttaggacaagataaagttagtactacattagttgatgattttaaaatgctaattgatggaaaaatttatccttatggagcacctagttatacagatgatcaaggggttctttacttatggttttctgatcaatttaagggatctgaagtatctgttaatttagttgttatagataaaattactggaggaaatataaaaccagatgatttttatgttaaagatataggttcaggttctcaatttttaaagcaatatgaagaatttactattgatgatactccaccatatttgattattaaaagatatgatggattaccatttgaagaagatgtagaaaaattatttttagattggatattaaaagatgggggtattccaataattactcctaaaggtgaaaaactcacagataaaaaatttatgactattagttctcaacgtttaaatgaggaaacaatggaaccagatacaaatttaggaagtgatgaccttacaaagcaagttgatgctggaaaatatcaattaagcattacatcaacacagttttcaaatgtatatccttttaatgaagcttattgggggcatagagcatattataaggcagaaattattcctgctgatacagaaacttcattagttgtagaagagtctaaagctaaaactgatgtttttaaaccaacagatacgtttacattaaatgttactatttcaccagataagaaagaaggaacagattgtgcctctccaagaggttacgtacaattctatattaatggaaaggaatataaagatccagtagaattaaaaactcataataagggtagtgagagtcataattatagtactgcatctattgaatggagacctttagatagcaatcatcatatttttactactgaacaaactattactgtaaaatatattggagatgatataaattacattgaaggtagtgaggatgaaaagaagttaaagttagatatgaca

SEQ ID NO: 175 - protein, 814 aa, Clostridium difficile
SNTFADTIEESTNAGNAEGDTNAGNAGGDANAGNAGGDANAGNAGGDANAGNAGGDANAGNAEEDSNAGNAEGDANAGNAEEDANAGNAEEDSNAGNAEEDMNALVVEEATAEDPTSVGDFKISGGEINVDFKFASGVLTILSGKQMTIQNNNPNTPTTHRIVIPKDVKAELIFDGVNIKTASNSPFTLTPDKDGGAYAHVILQDGSENKLESGDVYYPGMRAGKGTTLTIDDSVVNRDIEGEFIVPEGGKIPRDVTLENGDKLKKGDRLTLLDSNNRGSLKVVGNYYSAGIGGGNTESGGNIIINGGAITAIGQESSRNTGYGAGIGGGGNGSGGDITINGGTITAKGAYHGAGIGGGYYTTTKNALSPSVVDPSTGSGYSGNITINGGLSYSYGGAHGSAFGDGCVNPGTNRGYRILVTGGTILPYMTGVGDWIFDLSATTGDVIVTGGSLKATTFKSLGGAVAYGDLEKKTKVFMNKISLKYLGQDKVSTTLVDDFKMLIDGKIYPYGAPSYTDDQGVLYLWFSDQFKGSEVSVNLVVIDKITGGNIKPDDFYVKDIGSGSQFLKQYEEFTIDDTPPYLIIKRYDGLPFEEDVEKLFLDWILKDGGIPIITPKGEKLTDKKFMTISSQRLNEETMEPDTNLGSDDLTKQVDAGKYQLSITSTQFSNVYPFNEAYWGHRAYYKAEIIPADTETSLVVEESKAKTDVFKPTDTFTLNVTISPDKKEGTDCASPRGYVQFYINGKEYKDPVELKTHNKGSESHNYSTASIEWRPLDSNHHIFTTEQTITVKYIGDDINYIEGSEDEKKLKLDMT

SEQ ID NO: 176 - DNA, 1578 bp, Clostridium difficile
gacaatactacaaagcaagaaagattaataggtaaaacaagatatgaaacagcagtagaagtaagtaaattgggatgggttcaatcaaaaacagccattatagttaatggtaattctattcaaagtgcgctttgtgcaaatccatttgctaagctaaagaatgcacctatacttttagtaaacaacaacagtattgaaaattcaactaaggctgagcttaaaaggcttggtgtagataatgtgtacattgtagatagtggaaatagcatttcttctaaagtagaaaatgaaataaaatcacttaacataaaaataaataaaatagtaggaaacaatatatatgaaatgtctacaaatgtacttaaagaaatagataagataaaaaagatagaaaatgttgcagttgtaaatggactaaagggactatctgatgcagttagtatagcttctccagcagcaatacataatatgcctataatattagtatcagatgaaaacagcaatgatagtagtataaatttcttaaacaataggtctataaaaaaatcttacatagttggaggaaataagattttatcagacaatacagtaaagaaatatccaaacagagaaagaatcagtggttcagatagaaacaatactaatgcaaaaattattgataaattttataaagataaaaaaataaataatgtatttgtagctaaagatggtattaaccaagaaaatgcattagtagattcattatcaataggagtactagctgctaaagaaaattctcctataatgatatctaatggtagccttgtaaatagtcaaaaagaatttattaaaaataaagatatagatgaaataacacaagtaggaggaggatataatcaaaaagcatttgaagatattttaaaactaaaaaatgtgaacataagaaataaaactaaaaaaatatctttaatacaggctaaagaaatattaaaacaagctcttccaggaagcaatattttagtttgttattatgatgaagatgataatgaatatgactgcaaagttataaaggataatatcctatatgagatagaaattgatgcctactctggtaaaataatagaaattgaaaaagatgatgacttaaatgataataatttaggtacacaaaatatatcattggataaagctaagtctatagcattagatgctgttcctaatggtaatttaatctattgtaaatatgatgctgaagataacgaatacgaggctaaagtaataaaaaataagaaaacatatgaattagagataagtgcatttgatggaagaattgtagatattgacatggacaatgattctgatgatgactttgatgataatgataagaataactctaatactaatgacaacagttctattattagtgctgaaaaagctaaatcaataatgctagataaagtgcctggtgggaaaatagtaaaatttaagtatgatgaagatgacaaagaatatgaaggtgaaataataaaaggaaaaactgaatatgagataacaattaatgcaattactggtaaaatattagaatttgaaatagatgat

SEQ ID NO: 177 - protein, 526 aa, Clostridium difficile
DNTTKQERLIGKTRYETAVEVSKLGWVQSKTAIIVNGNSIQSALCANPFAKLKNAPILLVNNNSIENSTKAELKRLGVDNVYIVDSGNSISSKVENEIKSLNIKINKIVGNNIYEMSTNVLKEIDKIKKIENVAVVNGLKGLSDAVSIASPAAIHNMPIILVSDENSNDSSINFLNNRSIKKSYIVGGNKILSDNTVKKYPNRERISGSDRNNTNAKIIDKFYKDKKINNVFVAKDGINQENALVDSLSIGVLAAKENSPIMISNGSLVNSQKEFIKNKDIDEITQVGGGYNQKAFEDILKLKNVNIRNKTKKISLIQAKEILKQALPGSNILVCYYDEDDNEYDCKVIKDNILYEIEIDAYSGKIIEIEKDDDLNDNNLGTQNISLDKAKSIALDAVPNGNLIYCKYDAEDNEYEAKVIKNKKTYELEISAFDGRIVDIDMDNDSDDDFDDNDKNNSNTNDNSSIISAEKAKSIMLDKVPGGKIVKFKYDEDDKEYEGEIIKGKTEYEITINAITGKILEFEIDD

SEQ ID NO: 178 - DNA, 2013 bp, Clostridium difficile
tttacaccaatagtatcttatgctgacgaagtgactagcaatgatacaatacttaatggagaagaacaatcaaatggtcagacaccagatgtagagaaaccatcagacggtcaggtaccaggtggggagaaaccatcagacagtcaagtaccagatggggagaaaccatcagacggtcaggtaccagatggggagaaaccatcagatggtcagataccagatggggagaaaccatcagatggtcagataccagatggagagaaaccatcagatggtcagataccagatggggagaaaccatcagatggtcagatgccagatggagagaagacatcagatagtcagacgccagatgtagagaaaccatcagatggtcagatgccagatggggagaaaccattagatgagcaaactccagaagaagaaaaaccattggaagaagaaatagttatagaggaaatgagtttaaaacaagatattgataaaattcttgatatgactttatctcaaataaataaaatagtatataacttttgggaagatgaagaagatgtaaaggcagatgaacaatcagaaattaaccaagtttttacttcagaagactcatttattagcttatggtatgacaaaaaagcaaaagtaaaaaattcttgtttactaaaagaaatagatggttcagatagaccttatcatgatttaagatttgatgatattacaaagactttaacttttgactatgtaataaagggtcttgtaggagcaagctcaaaagacgacaaatatgtaatagaaggtgaagatggagagcaaactgcattttgttacaataatcatttaagaccaccaagtagtaatggaaagagtccatatttaccagcagaagattttaatggtcaagaaaaccaaaatgaagaagcagttaaatctatactatatgcaggttctgaatttgatggatttggatataagcaacaatttaatttaggtggagaagaaaatgaattgatgacttactcagctactcaaagtgcaatttggattattcttggacaaatggatgaacaagaaagacttaagcagtatcaaggttctataaacctttgtgataaacttatagaaagagcaaaaactgaagaggaaagagctgagtatcagaagaagaaagaagtagcgataaatataaaagcttatttagaagcattgttaaaagcaggtcgtgaagagttaaagccaaataatacaggaaaacctagtttgagtaatggtttaactaagattaactttgaaaaaaatgaagatggtacttatgaaacagaagctgtagccttagtaggttatagtggtgtagtaaagttaagactaccagatggagtaactgcttatgatgtagatggtaatataataggtacaggcgaagtagaaatttcaacgcaacagaaatttaaacttaagagtgttggaaaaccagatgccaaagctaatatttctgctgtatcttatgattatatttttccaaaagctattcaatattataaggcagtgcttgatttaggacaaaaagaccattcatcttcattaccatctagcaagcaaaatttattaagttatacaatagagaaaaagaatggtcaagaagttaactttaatataggtttaccaacagatgatgatgatgttgtaaatccaccagtgccaccaatagatgatgatgttgtaaatccaccggtgccaccaacagatgatacaaatggacataagccaaaaccatcaccaccaatagatgatacagtaataaatccaccagtaccaccaatggatgatacaataataaatccaccagtaccaccaacggaggatgcagtgttaaacccaccagtgccaccaatggaggatgcagtgctaaatccaccagtgccaccaacagatgatacagtgttaaatccaccagtaccaccagtaagtgatacagtggaaaaaactccagaactatcaagagatgatacaatagtaaaa

SEQ ID NO: 179 - protein, 671 aa, Clostridium difficile
FTPIVSYADEVTSNDTILNGEEQSNGQTPDVEKPSDGQVPGGEKPSDSQVPDGEKPSDGQVPDGEKPSDGQIPDGEKPSDGQIPDGEKPSDGQIPDGEKPSDGQMPDGEKTSDSQTPDVEKPSDGQMPDGEKPLDEQTPEEEKPLEEEIVIEEMSLKQDIDKILDMTLSQINKIVYNFWEDEEDVKADEQSEINQVFTSEDSFISLWYDKKAKVKNSCLLKEIDGSDRPYHDLRFDDITKTLTFDYVIKGLVGASSKDDKYVIEGEDGEQTAFCYNNHLRPPSSNGKSPYLPAEDFNGQENQNEEAVKSILYAGSEFDGFGYKQQFNLGGEENELMTYSATQSAIWIILGQMDEQERLKQYQGSINLCDKLIERAKTEEERAEYQKKKEVAINIKAYLEALLKAGREELKPNNTGKPSLSNGLTKINFEKNEDGTYETEAVALVGYSGVVKLRLPDGVTAYDVDGNIIGTGEVEISTQQKFKLKSVGKPDAKANISAVSYDYIFPKAIQYYKAVLDLGQKDHSSSLPSSKQNLLSYTIEKKNGQEVNFNIGLPTDDDDVVNPPVPPIDDDVVNPPVPPTDDTNGHKPKPSPPIDDTVINPPVPPMDDTIINPPVPPTEDAVLNPPVPPMEDAVLNPPVPPTDDTVLNPPVPPVSDTVEKTPELSRDDTIVK

SEQ ID NO: 180 - DNA, 891 bp, Clostridium difficile
cattcaggaagaactgattcatcaggaggtcatcgtgataataaaaataaatctggattaggaagttatcactatcattgtggtggttatccagctcatttacataataatggtggttgtccttatactggaggaggaagcagttctggaacagcaacttcggttaataatgaagaaaagcaaaagaggtctgttggagaaaaaggatataatcaagggtatgaagatgggtataaaggaaattatagttcatcaaattatagtggagattatagtgatacatatgaatcaaagtactcagaaggatatgaaaaaggtaaggctaaattagaagaggaagaaaaggtggctaaagagactggatataatttagggcttacaggtgctaaatctaataatacatatgaaaaagaagttttaaaaaatgcttatgataccggatattcaactggatacaatgaatataagactaaaaagatagaagaatataaagctaaagggatagaggatagcaataaagataaggaaaaaatgacatttgaagaaaacatagattctgaatttatagatgcttataataatgcttatgacgaaatacaagaacaattaaaaaatgattacactactcaaggatttgagagtgctatcaaaggagaaagatttgacacatcaactataggtaatgttaaatatgctaattggtttaaagaaggatatgataatggtaaggttaagttacctaaagcaaaagaaagtgtatataatcaaggttacaatgaagaagattttagtataccagatgaaatgaagtctattgaaactaagttaaaaggtgtatatgatgaaggtttagaaaaaagagaggaagagaaaagtagaaatgctacttat

SEQ ID NO: 181 - protein, 297 aa, Clostridium difficile
HSGRTDSSGGHRDNKNKSGLGSYHYHCGGYPAHLHNNGGCPYTGGGSSSGTATSVNNEEKQKRSVGEKGYNQGYEDGYKGNYSSSNYSGDYSDTYESKYSEGYEKGKAKLEEEEKVAKETGYNLGLTGAKSNNTYEKEVLKNAYDTGYSTGYNEYKTKKIEEYKAKGIEDSNKDKEKMTFEENIDSEFIDAYNNAYDEIQEQLKNDYTTQGFESAIKGERFDTSTIGNVKYANWFKEGYDNGKVKLPKAKESVYNQGYNEEDFSIPDEMKSIETKLKGVYDEGLEKREEEKSRNATY

SEQ ID NO: 182 - DNA, 1746 bp, Clostridium difficile
tatagtacatctagcaacaaaagtgttgatttatatagtgatgtatatattgaaaaatattttaacagagacaaggttatggaagttaatatagagatagatgaaagtgacttgaaggatatgaatgaaaatgctataaaagaagaatttaaggttgcaaaagtaactgtagatggagatacatatggaaacgtaggtataagaactaaaggaaattcaagtcttatatctgtagcaaatagtgatagtgatagatacagctataagattaattttgataagtataatactagtcaaagtatggaagggcttactcaattaaatcttaataactgttactctgacccatcttatatgagagagtttttaacatatagtatttgcgaggaaatgggattagcgactccagaatttgcatatgctaaagtctctataaatggcgaatatcatggtttgtatttggcagtagaaggattaaaagagtcttatcttgaaaataattttggtaatgtaactggagacttatataagtcagatgaaggaagctcgttgcaatataaaggagatgacccagaaagttactcaaacttaatcgttgaaagtgataaaaagacagctgattggtctaaaattacaaaactattaaaatctttggatacaggtgaagatattgaaaaatatcttgatgtagattctgtccttaaaaatatagcaataaatacagctttattaaaccttgatagctatcaagggagttttgcccataactattatttatatgagcaagatggagtattttctatgttaccatgggattttaatatgtcatttggtggatttagtggttttggtggaggtagtcaatctatagcaattgatgaacctacgacaggtaatttagaagatagacctctcatatcctcgttattaaaaaatgagacatacaaaacaaaataccataaatatctggaagagatagtaacaaaatacctagattcagactatttagagaatatgacaacaaaattgcatgacatgatagcatcatatgtaaaagaagacccaacagcattttatacttatgaagaatttgaaaaaaatataacatcttcaattgaagattctagtgataataagggatttggtaataaagggtttgacaacaataactctaataacagtgattctaataataattctaatagtgaaaataagcgctctggaaatcaaagtgatgaaaaagaagttaatgctgaattaacatcaagcgtagtcaaagctaatacagataatgaaactaaaaataaaactacaaatgatagtgaaagtaagaataatacagataaagataaaagtggaaatgataataatcaaaagctagaaggtcctatgggtaaaggaggtaagtcaataccaggggttttggaagttgcagaagatatgagtaaaactataaaatctcaattaagtggagaaacttcttcgacaaagcaaaactctggtgatgaaagttcaagtggaattaaaggtagtgaaaagtttgatgaggatatgagtggtatgccagaaccacctgagggaatggatggtaaaatgccaccaggaatgggtaatatggataagggagatatgaatggtaaaaatggcaatatgaatatggatagaaatcaagataatccaagagaagctggaggttttggcaatagaggaggaggctctgtgagtaaaacaacaacatacttcaaa

SEQ ID NO: 183 - protein, 582 aa, Clostridium difficile
YSTSSNKSVDLYSDVYIEKYFNRDKVMEVNIEIDESDLKDMNENAIKEEFKVAKVTVDGDTYGNVGIRTKGNSSLISVANSDSDRYSYKINFDKYNTSQSMEGLTQLNLNNCYSDPSYMREFLTYSICEEMGLATPEFAYAKVSINGEYHGLYLAVEGLKESYLENNFGNVTGDLYKSDEGSSLQYKGDDPESYSNLIVESDKKTADWSKITKLLKSLDTGEDIEKYLDVDSVLKNIAINTALLNLDSYQGSFAHNYYLYEQDGVFSMLPWDFNMSFGGFSGFGGGSQSIAIDEPTTGNLEDRPLISSLLKNETYKTKYHKYLEEIVTKYLDSDYLENMTTKLHDMIASYVKEDPTAFYTYEEFEKNITSSIEDSSDNKGFGNKGFDNNNSNNSDSNNNSNSENKRSGNQSDEKEVNAELTSSVVKANTDNETKNKTTNDSESKNNTDKDKSGNDNNQKLEGPMGKGGKSIPGVLEVAEDMSKTIKSQLSGETSSTKQNSGDESSSGIKGSEKFDEDMSGMPEPPEGMDGKMPPGMGNMDKGDMNGKNGNMNMDRNQDNPREAGGFGNRGGGSVSKTTTYFK

SEQ ID NO: 184 - DNA, 1935 bp, Clostridium difficile
tacaaagtaaatgctgatgagactaaagttaaaaattataagtttgaaagagatataactattgatggtgttataggaagtaatagtactttttttgaagtaaataaaaattgggatattgaagaagttttattgcatcttaattttagtaagagccaaatattaaatggagatgtttcaagtttaactgtattgataaataatgtaccaataaaatctattaaattaaatgctaagacaaattataaaaatacattagaagtattagttccaaaagattatataattcaaggatataatgaaataaaaataaaaacatacaaaacaatatctgataaaatttgccaggatgattccaatactgggaactggatggttattcacaaagaatcatatatatcaattagatataagcagaaaaaggtggaaaactcaataaatgaatatccgtatccatatgcagaaattgaaaataatcataaattagatacaactatagtagtaccagataatatgactagaggagagactacagcagtgtttaatttggcatcagcatttggaaaaataacaaaaaatgatgatttaaagttagatgttaaattatattcagaaatgaaaaattggtcagatgataatattatatatattggtaaacctgaaaatacagcagaagaaattttggatattttaagtataaaggaacaaaccctattatcttcaaactgtataatcaagcaagtagattcaccatacaataagaataagaagatgatggtggtaattggtagtaatgaagatgatttaataaaggcatcaaatttattaatagaaaatagactttctaatcaagttttatcatcatcagtacttgtaaacaaagagactaatataaaaattaatagggaacaaaaattaaatttaggtcatttaacattaaaagacttaggatattctgactttttgttggaaggagcatttaatcaacaagctttatttgatgtcaaaataccaacgggtaaggtattagatgatggttcaaagattatcttaaatttaagatattctgacaatttagattttgaaaaatctttagttacagtgtctataaatgatgttattgtgggaagtaaaaaattggataggtcacattctaataatgataagttagaattaaaaatacctaaagatatagataataaaaactattatcaagttaaattgacatttaatttgagtataaaaaattcgaattgtgttactagagagagtaataatccttgggcatatgtatcaaataattcttatttggcgttatctacgaaagaaaatgaaaccttatcttttgaaaattatccgtatccatttgttagagatgatgaatttaatgatttaactgtgataatgccagattattcagggtcacaagctatgacctggatgtttagattaggtgttactttaggtgcgaatataaattcacataatggaaatataaatgtaattagaggaaaagaatttagtgacaagtataaggatactaatattgtagtttttggagtgccacataataattctgttataaagatgttaaataataatttaaatataaagttcgataaaaattactccaattttatatcaaatgataagataagctttattgatgattatggaaaaaatatttctaccattcaattaataaaatcaccatataataatcaaaaaaatatcatggtaattagttcaatgaatgaaaaaaacttatatttaggaatggattatttgttgaataaaagtaaagttaatgatttaaaaggagatacattgataattgatgaatacggagaggtagaagatttagcttataatttaaaatctaagaaagaagtaaaagattcaagttggaatatgagtataaataagacaactaaa

SEQ ID NO: 185 - protein, 645 aa, Clostridium difficile
YKVNADETKVKNYKFERDITIDGVIGSNSTFFEVNKNWDIEEVLLHLNFSKSQILNGDVSSLTVLINNVPIKSIKLNAKTNYKNTLEVLVPKDYIIQGYNEIKIKTYKTISDKICQDDSNTGNWMVIHKESYISIRYKQKKVENSINEYPYPYAEIENNHKLDTTIVVPDNMTRGETTAVFNLASAFGKITKNDDLKLDVKLYSEMKNWSDDNIIYIGKPENTAEEILDILSIKEQTLLSSNCIIKQVDSPYNKNKKMMVVIGSNEDDLIKASNLLIENRLSNQVLSSSVLVNKETNIKINREQKLNLGHLTLKDLGYSDFLLEGAFNQQALFDVKIPTGKVLDDGSKIILNLRYSDNLDFEKSLVTVSINDVIVGSKKLDRSHSNNDKLELKIPKDIDNKNYYQVKLTFNLSIKNSNCVTRESNNPWAYVSNNSYLALSTKENETLSFENYPYPFVRDDEFNDLTVIMPDYSGSQAMTWMFRLGVTLGANINSHNGNINVIRGKEFSDKYKDTNIVVFGVPHNNSVIKMLNNNLNIKFDKNYSNFISNDKISFIDDYGKNISTIQLIKSPYNNQKNIMVISSMNEKNLYLGMDYLLNKSKVNDLKGDTLIIDEYGEVEDLAYNLKSKKEVKDSSWNMSINKTTK

SEQ ID NO: 186 - DNA, 573 bp, Clostridium difficile
atgaaaaataagaaaataatgttagtgttaagtatattatctatatctatattcgcagttggttgtactaatgctcaaaatggaagtgattcatctaaaaaagaaactaagagcaatacaaatgttgagcaaccaaaagaagaaaacaatactgaaaaagaggttcctaataacaaagctaaacctactccaaaagaagaaactaaagctcaatcagctactatttactcttttgatgtagataagacagatttaattgaaaataaagttgatttaaataaaattgatgagaacactttatttgaagaacttcaaaaacttaaagttgttccagaatctgcaaaattaaattcatttactacaaaagacattgatggtgtaaaaactggtatattagatgttagctctgactttacaaagtcaaacttaggtagtgatgcagaaactttaatgcttgattcagttgctcgtacttacataaaaaatatgaatgttgaacaaataaaaattactgttgatggttctaattacgaaagtggtcatatagttcttgaagaaggagattacttaaag

SEQ ID NO: 187 - protein, 191 aa, Clostridium difficile
MKNKKIMLVLSILSISIFAVGCTNAQNGSDSSKKETKSNTNVEQPKEENNTEKEVPNNKAKPTPKEETKAQSATIYSFDVDKTDLIENKVDLNKIDENTLFEELQKLKVVPESAKLNSFTTKDIDGVKTGILDVSSDFTKSNLGSDAETLMLDSVARTYIKNMNVEQIKITVDGSNYESGHIVLEEGDYLK

SEQ ID NO: 188 - DNA, 510 bp, Clostridium difficile
tgtactaatgctcaaaatggaagtgattcatctaaaaaagaaactaagagcaatacaaatgttgagcaaccaaaagaagaaaacaatactgaaaaagaggttcctaataacaaagctaaacctactccaaaagaagaaactaaagctcaatcagctactatttactcttttgatgtagataagacagatttaattgaaaataaagttgatttaaataaaattgatgagaacactttatttgaagaacttcaaaaacttaaagttgttccagaatctgcaaaattaaattcatttactacaaaagacattgatggtgtaaaaactggtatattagatgttagctctgactttacaaagtcaaacttaggtagtgatgcagaaactttaatgcttgattcagttgctcgtacttacataaaaaatatgaatgttgaacaaataaaaattactgttgatggttctaattacgaaagtggtcatatagttcttgaagaaggagattacttaaag

SEQ ID NO: 189 - protein, 170 aa, Clostridium difficile
CTNAQNGSDSSKKETKSNTNVEQPKEENNTEKEVPNNKAKPTPKEETKAQSATIYSFDVDKTDLIENKVDLNKIDENTLFEELQKLKVVPESAKLNSFTTKDIDGVKTGILDVSSDFTKSNLGSDAETLMLDSVARTYIKNMNVEQIKITVDGSNYESGHIVLEEGDYLK

SEQ ID NO: 190 - protein, 278 aa, Clostridium difficile
MSSISPVRVTGLSGNFDMEGIIEASMIRDKEKVNKAKQDQQIVKWKQEIYRDIIKESKNLYDKYLNGDSPNSITNKKAYSATRITSSDESIIVAKGSAGAEKINYQFAVSQMAEPAKVTIKLNSSDPIVQQFPPNASGASSLNIGGVNIPISEQDTTSTIVSKINSLCADNDIRASYSEMTGELIISRKQTGSSSDIDLKVIGNDSLAGQIASDNGITFTTDASGTKSAVVYGKNLEADVTDDQGRVTHISKEQNSFKIDNIDYNVNSKGSAKLVSVT

SEQ ID NO: 191 - protein, 229 aa, Clostridium difficile
DTEEATKNMKAFVDDYNALMDKVYGLVTTKKSKDYPPLTDEQKDDMTTEEIEKWEKKAKEGILRNDDELRAFVEDIQSMFFGDADTIIALRKLGISEHENYNKKGQISFNADTFSKALIDDSDKVYKALAGYSSNYDDKGMFEKLKKIVFEYSGSSASKLTKKAGMENSSSASQNVYSKQIAEQERNISRLVEKMNDKEKRLYAKYSALESLLNKYSSQMNYFSQAQGN

SEQ ID NO: 192 - DNA, 1884 bp, Clostridium difficile
gtgttaatgaataaaagaaaatcttttataagaactatagcagtatcaactatggcagtagctgtaactggtagtgctacatgtgcatatgcagctccagttttacaaggaacaaaaacgtatgagaaagtaaatactatagatatatctgtggactcagtagaaaacatagtatattcatttcaagccagtataaaagtacaaggtgaggttgaagtagtagataatgagcagaaagaaaagattacttggtctgataatataaaatctcagataaaaagtggaaatgcaaatgctacttgtagagcagaatacaacaaatcaagtaatacaactacattagatatatacgttacatcaaatgaagatttactagacggaaatagattgaatataggaagaatatctgtaaaaaaatctggcagtaactcaaatgctgactataaagttttaggaaaaggaacaagtgataaaccagctttaaaaattgtaacatataacaacaaaacagtggattatgaaaatataagctctgatgaaggattaatatttacccttattaatgagagtgaagtaaaaccaattggtggaactggttctagtaaaaatgaccctgaaaagtataaggtagagaaaagtgaagcacttgaatatttattaaacaatattaggataaactattctattgttagtaaagaaacacaagaaagtggttcaaatgtaatattaaaacttggattagcacaaaaaacaactaagggaagaaaagctacaataaacaaatatgttgaagttacacttccaaaaagtttagaatacatagttgaaaatgaattatcaaaaccggatgaattaccaccagataatggtagtggtggaaataatggtggaggaagtaattcaggcggctcatctagtggtggaagctctggaggaggaaattcaagtgattctacatctaatgtcacagtcaaaaaattaaaaggtgctgatagatttgagacagctatcaaaatatctcaaagtggttggacaaaatcagatacagttgtaatagtaaatggagaagataaaagtatggtggatgggcttacagctacaccacttgctagtgtaaaaaactcaccgattcttttatcatcaaatgaaaagcttcctcaaaaaactgtagaagaattgaaaaggctaaatccatcaaaagtagttgtgataggtggaaacaactcaatgccaaattcagttgttgaagctatcaaagctgtaaattcaaaaatatcagtacaaagaataggtggagatacaagatatcaaacttctattaatatagcaaaagaaatagataggacgaataatgtgagcaagttgtatataggagcaggaaatggagaagctgattcattatcaatagcatcactggctggtaaagaaaaaactccaatagtacttacacaaaaagatggtgtagataatgaagctgaacaatttattaaatcaaataaggtgtcaaatatatattttattggtggagtagaaaaaatatctaacaaggctattgaacaagttggaaaaatagcaaacaaagatatatcaaacaatagggtggcaggtcaaactagacaagagacgaatgccaaagtaatagataaattctactctcaatctaagctagatggagttgtagttgcaaatcaagacaaacttatagacgctttagcagttggaccattagcagctaaaaacaattcaccagttatacttgctacaaatacgttagataaatcacaagaatcgtcattaaaaggtaaaaattcatcaaagttgtttgaagtaggtggaggaatagcctcatctgtaatagacaagattaagagtttaattgaaaaa

SEQ ID NO: 193 - protein, 628 aa, Clostridium difficile
MLMNKRKSFIRTIAVSTMAVAVTGSATCAYAAPVLQGTKTYEKVNTIDISVDSVENIVYSFQASIKVQGEVEVVDNEQKEKITWSDNIKSQIKSGNANATCRAEYNKSSNTTTLDIYVTSNEDLLDGNRLNIGRISVKKSGSNSNADYKVLGKGTSDKPALKIVTYNNKTVDYENISSDEGLIFTLINESEVKPIGGTGSSKNDPEKYKVEKSEALEYLLNNIRINYSIVSKETQESGSNVILKLGLAQKTTKGRKATINKYVEVTLPKSLEYIVENELSKPDELPPDNGSGGNNGGGSNSGGSSSGGSSGGGNSSDSTSNVTVKKLKGADRFETAIKISQSGWTKSDTVVIVNGEDKSMVDGLTATPLASVKNSPILLSSNEKLPQKTVEELKRLNPSKVVVIGGNNSMPNSVVEAIKAVNSKISVQRIGGDTRYQTSINIAKEIDRTNNVSKLYIGAGNGEADSLSIASLAGKEKTPIVLTQKDGVDNEAEQFIKSNKVSNIYFIGGVEKISNKAIEQVGKIANKDISNNRVAGQTRQETNAKVIDKFYSQSKLDGVVVANQDKLIDALAVGPLAAKNNSPVILATNTLDKSQESSLKGKNSSKLFEVGGGIASSVIDKIKSLIEK

SEQ ID NO: 194 - DNA, 1791 bp, Clostridium difficile
gctccagttttacaaggaacaaaaacgtatgagaaagtaaatactatagatatatctgtggactcagtagaaaacatagtatattcatttcaagccagtataaaagtacaaggtgaggttgaagtagtagataatgagcagaaagaaaagattacttggtctgataatataaaatctcagataaaaagtggaaatgcaaatgctacttgtagagcagaatacaacaaatcaagtaatacaactacattagatatatacgttacatcaaatgaagatttactagacggaaatagattgaatataggaagaatatctgtaaaaaaatctggcagtaactcaaatgctgactataaagttttaggaaaaggaacaagtgataaaccagctttaaaaattgtaacatataacaacaaaacagtggattatgaaaatataagctctgatgaaggattaatatttacccttattaatgagagtgaagtaaaaccaattggtggaactggttctagtaaaaatgaccctgaaaagtataaggtagagaaaagtgaagcacttgaatatttattaaacaatattaggataaactattctattgttagtaaagaaacacaagaaagtggttcaaatgtaatattaaaacttggattagcacaaaaaacaactaagggaagaaaagctacaataaacaaatatgttgaagttacacttccaaaaagtttagaatacatagttgaaaatgaattatcaaaaccggatgaattaccaccagataatggtagtggtggaaataatggtggaggaagtaattcaggcggctcatctagtggtggaagctctggaggaggaaattcaagtgattctacatctaatgtcacagtcaaaaaattaaaaggtgctgatagatttgagacagctatcaaaatatctcaaagtggttggacaaaatcagatacagttgtaatagtaaatggagaagataaaagtatggtggatgggcttacagctacaccacttgctagtgtaaaaaactcaccgattcttttatcatcaaatgaaaagcttcctcaaaaaactgtagaagaattgaaaaggctaaatccatcaaaagtagttgtgataggtggaaacaactcaatgccaaattcagttgttgaagctatcaaagctgtaaattcaaaaatatcagtacaaagaataggtggagatacaagatatcaaacttctattaatatagcaaaagaaatagataggacgaataatgtgagcaagttgtatataggagcaggaaatggagaagctgattcattatcaatagcatcactggctggtaaagaaaaaactccaatagtacttacacaaaaagatggtgtagataatgaagctgaacaatttattaaatcaaataaggtgtcaaatatatattttattggtggagtagaaaaaatatctaacaaggctattgaacaagttggaaaaatagcaaacaaagatatatcaaacaatagggtggcaggtcaaactagacaagagacgaatgccaaagtaatagataaattctactctcaatctaagctagatggagttgtagttgcaaatcaagacaaacttatagacgctttagcagttggaccattagcagctaaaaacaattcaccagttatacttgctacaaatacgttagataaatcacaagaatcgtcattaaaaggtaaaaattcatcaaagttgtttgaagtaggtggaggaatagcctcatctgtaatagacaagattaagagtttaattgaaaaa

SEQ ID NO: 195 - protein, 597 aa, Artificial Sequence
  Clostridium difficile
APVLQGTKTYEKVNTIDISVDSVENIVYSFQASIKVQGEVEVVDNEQKEKITWSDNIKSQIKSGNANATCRAEYNKSSNTTTLDIYVTSNEDLLDGNRLNIGRISVKKSGSNSNADYKVLGKGTSDKPALKIVTYNNKTVDYENISSDEGLIFTLINESEVKPIGGTGSSKNDPEKYKVEKSEALEYLLNNIRINYSIVSKETQESGSNVILKLGLAQKTTKGRKATINKYVEVTLPKSLEYIVENELSKPDELPPDNGSGGNNGGGSNSGGSSSGGSSGGGNSSDSTSNVTVKKLKGADRFETAIKISQSGWTKSDTVVIVNGEDKSMVDGLTATPLASVKNSPILLSSNEKLPQKTVEELKRLNPSKVVVIGGNNSMPNSVVEAIKAVNSKISVQRIGGDTRYQTSINIAKEIDRTNNVSKLYIGAGNGEADSLSIASLAGKEKTPIVLTQKDGVDNEAEQFIKSNKVSNIYFIGGVEKISNKAIEQVGKIANKDISNNRVAGQTRQETNAKVIDKFYSQSKLDGVVVANQDKLIDALAVGPLAAKNNSPVILATNTLDKSQESSLKGKNSSKLFEVGGGIASSVIDKIKSLIEK

SEQ ID NO: 196 - DNA, 25 bp, Artificial Sequence
  Primer
tttttcaattaaactcttaatcttg

SEQ ID NO: 197 - DNA, 22 bp, Artificial Sequence
  Primer
ggtagtaagattgtatttgcac

SEQ ID NO: 198 - DNA, 24 bp, Artificial Sequence
  Primer
ttcttcttttttcacttgtttagg

SEQ ID NO: 199 - DNA, 16 bp, Artificial Sequence
  Primer
gcacctgtgtttgcag

SEQ ID NO: 200 - DNA, 25 bp, Artificial Sequence
  Primer
agaactagcatcaatatctattgtc

SEQ ID NO: 201 - DNA, 22 bp, Artificial Sequence
  Primer
tcaagtataagtccagtaagag

SEQ ID NO: 202 - DNA, 19 bp, Artificial Sequence
  Primer
attaccttgtgcttgtgag

SEQ ID NO: 203 - DNA, 23 bp, Artificial Sequence
  Primer
agagttaatacaaatgtaagtgc

SEQ ID NO: 204 - DNA, 24 bp, Artificial Sequence
  Primer
tcctaataattgtaaaactccttg

SEQ ID NO: 205 - DNA, 20 bp, Artificial Sequence
  Primer
tgttcaatggaaggaccaag

SEQ ID NO: 206 - DNA, 25 bp, Artificial Sequence
  Primer
attcttaaagtcttttatattttcc

SEQ ID NO: 207 - DNA, 22 bp, Artificial Sequence
  Primer
ccagcattgtttagaaatatag

SEQ ID NO: 208 - DNA, 19 bp, Artificial Sequence
  Primer
atttaaaggaccccatccc

SEQ ID NO: 209 - DNA, 25 bp, Artificial Sequence
  Primer
ctagataagattgaaaatattcaag

SEQ ID NO: 210 - DNA, 20 bp, Artificial Sequence
  Primer
cttctttacagcatccaaac

SEQ ID NO: 211 - DNA, 20 bp, Artificial Sequence
  Primer
cttgaaaagggaacagtaac

SEQ ID NO: 212 - DNA, 21 bp, Artificial Sequence
  Primer
aacaaatcttcttgcaccaag

SEQ ID NO: 213 - DNA, 25 bp, Artificial Sequence
  Primer
tgttcaaaaaaagaagattctaaag

SEQ ID NO: 214 - DNA, 21 bp, Artificial Sequence
  Primer
ttgtgctagtaatccatttgc

SEQ ID NO: 215 - DNA, 22 bp, Artificial Sequence
  Primer
aatcccaaaagagagttgatag

SEQ ID NO: 216 - DNA, 23 bp, Artificial Sequence
  Primer
gctcttaaatagactataatcac

SEQ ID NO: 217 - DNA, 33 bp, Artificial Sequence
  Primer
attataataaattatgaattaattgtaaaatac

SEQ ID NO: 218 - DNA, 21 bp, Artificial Sequence
  Primer
atcctctgtttctaagtcttg

SEQ ID NO: 219 - DNA, 27 bp, Artificial Sequence
  Primer
ggatatagaagtattaataagtcattt

SEQ ID NO: 220 - DNA, 23 bp, Artificial Sequence
  Primer
tcttaaaacatcaaacattcctc

SEQ ID NO: 221 - DNA, 20 bp, Artificial Sequence
  Primer
gctccagttttacaaggaac

SEQ ID NO: 222 - DNA, 25 bp, Artificial Sequence
  Primer
tttttcaattaaactcttaatcttg

SEQ ID NO: 223 - DNA, 24 bp, Artificial Sequence
  Primer
tcagaattaggagagaatagtcag

SEQ ID NO: 224 - DNA, 24 bp, Artificial Sequence
  Primer
tttatcatcatttattgaaatctg

SEQ ID NO: 225 - DNA, 26 bp, Artificial Sequence
  Primer
tcaccaataagtaatgttgttataac

SEQ ID NO: 226 - DNA, 20 bp, Artificial Sequence
  Primer
tactggtggatttaccaaag

SEQ ID NO: 227 - DNA, 25 bp, Artificial Sequence
  Primer
tcaaatactttcgcagatactatag

SEQ ID NO: 228 - DNA, 27 bp, Artificial Sequence
  Primer
tgtcatatctaactttaacttcttttc

SEQ ID NO: 229 - DNA, 23 bp, Artificial Sequence
  Primer
gacaatactacaaagcaagaaag

SEQ ID NO: 230 - DNA, 29 bp, Artificial Sequence
  Primer
atcatctatttcaaattctaatattttac

SEQ ID NO: 231 - DNA, 25 bp, Artificial Sequence
  Primer
tttacaccaatagtatcttatgctg

SEQ ID NO: 232 - DNA, 23 bp, Artificial Sequence
  Primer
ttttactattgtatcatctcttg

SEQ ID NO: 233 - DNA, 23 bp, Artificial Sequence
  Primer
cattcaggaagaactgattcatc

SEQ ID NO: 234 - DNA, 24 bp, Artificial Sequence
  Primer
ataagtagcatttctacttttctc

SEQ ID NO: 235 - DNA, 25 bp, Artificial Sequence
  Primer
tatagtacatctagcaacaaaagtg

SEQ ID NO: 236 - DNA, 25 bp, Artificial Sequence
  Primer
tttgaagtatgttgttgttttactc

SEQ ID NO: 237 - DNA, 23 bp, Artificial Sequence
  Primer
tacaaagtaaatgctgatgagac

SEQ ID NO: 238 - DNA, 28 bp, Artificial Sequence
  Primer
tttagttgtcttatttatactcatattc

SEQ ID NO: 239 - DNA, 19 bp, Artificial Sequence
  Primer
ttaccgagtacacccgttc

SEQ ID NO: 240 - DNA, 24 bp, Artificial Sequence
  Primer
attgtagatagaatgggcttcatc

SEQ ID NO: 241 - DNA, 21 bp, Artificial Sequence
  Primer
gatgaagcccattctatctac

SEQ ID NO: 242 - DNA, 17 bp, Artificial Sequence
  Primer
gtcgctaggtctgctag

SEQ ID NO: 243 - DNA, 23 bp, Artificial Sequence
  Primer
caaactgtggcaacaaatttaac

SEQ ID NO: 244 - DNA, 23 bp, Artificial Sequence
  Primer
gttagaacttggactatttccac

SEQ ID NO: 245 - DNA, 25 bp, Artificial Sequence
  Primer
aaggtaggtcaaataaaatttagtg

SEQ ID NO: 246 - DNA, 29 bp, Artificial Sequence
  Primer
ttttaatatattaaataaacttgatagcc

SEQ ID NO: 247 - DNA, 27 bp, Artificial Sequence
  Primer
actgaatctaatgctatggaaaataac

SEQ ID NO: 248 - DNA, 26 bp, Artificial Sequence
  Primer
ttttaatgaatcttctatgcctttac

SEQ ID NO: 249 - DNA, 26 bp, Artificial Sequence
  Primer
tgtagtaatactaaaacaaaacaaag

SEQ ID NO: 250 - DNA, 24 bp, Artificial Sequence
  Primer
atttgattcattcgattttatatc

SEQ ID NO: 251 - DNA, 25 bp, Artificial Sequence
  Primer
cttgaaacaatttatactattcaag

SEQ ID NO: 252 - DNA, 24 bp, Artificial Sequence
  Primer
tttatattcaaaaaaatcttctcc

SEQ ID NO: 253 - DNA, 21 bp, Artificial Sequence
  Primer
tgttcaccaggaaaagataac

SEQ ID NO: 254 - DNA, 21 bp, Artificial Sequence
  Primer
tttctcaacaaagtatattgc

SEQ ID NO: 255 - DNA, 24 bp, Artificial Sequence
  Primer
tgttcatcaggaaataataaaaat

SEQ ID NO: 256 - DNA, 20 bp, Artificial Sequence
  Primer
ctcattaataggctccttag

SEQ ID NO: 257 - DNA, 25 bp, Artificial Sequence
  Primer
tgtagtagtaaaccaaaagaaaaag

SEQ ID NO: 258 - DNA, 21 bp, Artificial Sequence
  Primer
taatacctttgctttccagtc

SEQ ID NO: 259 - DNA, 2025 bp, Clostridium difficile
atgatgaaaaaaacaacaaaattattggcaacaggaatgttgtctgtagcaatggtggcaccaaacgtagctttagcggctgaaaatactactgcaaatacagaatctaattcagatattaatataaatttacaaagaaaaagtgtagtgttaggaagtaaatctaatgcaagtgtaaaatttaaagaaaaattaaatgctgattcaataacattaaattttatgtgttatgatatgccacttgaagctactttaaattacaatgaaaagacagattcatatgaaggtgtaataaactataacaaagacccagaatacttaaatgtatgggaacttcaaagcataaaaataaatggtaaagatgaacagaaagttttaaacaaagaagacttagagtctatgggattaaatcttaaggattatgatgttacacaagagtttataataagtgatgcaaattcaacaaaagcagtaaatgaatatatgagaaaaacttctgcaccagtaaaaaaacttgctggagctactagatttgaaactgctgttgagataagtaaacagggttggaaagatgggtctagtaaggttgtaatagttaatggagaattagcagcagatggaattacagctactccacttgcatctacatatgacgcaccaatattacttgcaaataaagatgatataccagaaagtacaaaagcagagttaaaacgtctaaatccaagtgatgtaataattataggtgatgatggttcagtttcacaaaaggcagtgtctcaaattaaatctgctgtaaatgtaaatgtgactcgtattggtggagttgatagacatgaaacatctttacttatagcaaaagaaatagataagtatcatgatgttaataaaatatacatagcaaatggatatgctggtgaatatgatgctcttaatatttcatcaaaagctggtgaagaccaacaacctataatattagctaataaagattctgtaccacaaggtacatataattggttatcttcacaaggtttagaagaagcttattacataggtggtagtcaaagtttatcatcaaaaattatagaccaaatatctaaaatagcaaaaaatggtacttcaaaaaatagagtttctggagcagatagacatgaaacaaatgcaaatgtaattaagactttctatccagataaagagttgagtgcaatgttagttgcaaaatctgacataatagttgattcaataacagcaggacctttagcagctaaattaaaagctccaatacttataactccaaaaacttatgtttctgcataccatagtacaaacttatcagaaaaaacagcagaaacagtatatcaaattggtgatggaatgaaagatagtgttataaattctatagcatctagtttatcaaaacacaatgcaccaacagaaccagataattcaggttcagcagcaggaaaaactgtagtgatagacccaggtcatgggggttctgattcaggggcaacaagtggattaaatggtggagcacaagaaaagaaatatactcttaatacagcattagcaactactgaatatttacgttcaaaaggtataaatgttgttatgactagagatacagataaaacaatggctttaggagaaagaacagcattatcaaatactataaagccagatttatttacaagtatacattacaatgcgtctaatggatctggtaatggtgtggaaatttattacaaagtaaaagataaaaatggtggaacaactaagactgcagcatcaaatatcttaaaaagaatactagaaaaatttaacatgaaaaatagaggaatcaagacaagaacacttgataatggaaaagattacctatatgtgttaagaaataacaattatccagcaatacttgttgaatgtgcatttattgacaataagagcgatatggataagttaaatactgcagaaaaagtaaaaacaatgggaactcaaattggaataggaatagaagatacagtaaaa

SEQ ID NO: 260 - protein, 675 aa, Clostridium difficile
MMKKTTKLLATGMLSVAMVAPNVALAAENTTANTESNSDININLQRKSVVLGSKSNASVKFKEKLNADSITLNFMCYDMPLEATLNYNEKTDSYEGVINYNKDPEYLNVWELQSIKINGKDEQKVLNKEDLESMGLNLKDYDVTQEFIISDANSTKAVNEYMRKTSAPVKKLAGATRFETAVEISKQGWKDGSSKVVIVNGELAADGITATPLASTYDAPILLANKDDIPESTKAELKRLNPSDVIIIGDDGSVSQKAVSQIKSAVNVNVTRIGGVDRHETSLLIAKEIDKYHDVNKIYIANGYAGEYDALNISSKAGEDQQPIILANKDSVPQGTYNWLSSQGLEEAYYIGGSQSLSSKIIDQISKIAKNGTSKNRVSGADRHETNANVIKTFYPDKELSAMLVAKSDIIVDSITAGPLAAKLKAPILITPKTYVSAYHSTNLSEKTAETVYQIGDGMKDSVINSIASSLSKHNAPTEPDNSGSAAGKTVVIDPGHGGSDSGATSGLNGGAQEKKYTLNTALATTEYLRSKGINVVMTRDTDKTMALGERTALSNTIKPDLFTSIHYNASNGSGNGVEIYYKVKDKNGGTTKTAASNILKRILEKFNMKNRGIKTRTLDNGKDYLYVLRNNNYPAILVECAFIDNKSDMDKLNTAEKVKTMGTQIGIGIEDTVK

SEQ ID NO: 261 - DNA, 1599 bp, Clostridium difficile
atgaaaatgaacaaaaaaatattatcattaggtctagcagtatcattaatcttagtaaacttcaaaagtgtaaatgcatcatcagtagtagaaaaaatatacggtaaagatagatatgaaacagcagcaaagatagctgataaacagacttatgaaacagtaattttagtaaatacagaaaaatcacttgcagatggattaagtgtaagtggattatcaggagctacaaaagctccaatactatttacacaacaaaataagataccagcagacacaaatagatgtctaaaaaatatcaaaaaagcatatataataggtacagaagatactataagtaaatcagtagaaaaagaactagattctaaaaatatagaagtaaaaagaattggtggagaagatagactaaaaacaagctatttaatagctaaagaaatagcaactataaaaaaagtggataaagtactattaactaatgcatatagtggagaagcagatgcaatgagtgtatcatcagtagctactagagatggagctccaatcatacttacagatggaaagagtgtgccttttgatgtaaaaaatattcaatcatattgtataggttcagaggagataatgagtaatcctctagttaaaaatacaaactcagtaagaatagaaggaactgaccgatttgaaactaacaaaaacgtaatagactacttttttaatagtgcagatggattctatgtatcagatggataccaattagtagatgcaatagcagctgcaccacttactaaaaactctccaatggtactagtaaatgatggaagcgataaaactgtattagaaggagctaagaatataacctctgtaggtgaaataaatgagaaggtaatacaacagtgtataaatgcttcaaagtcaaatggacaacccccaacaattacagttggaagtacagaggtatataagggtgaaaagtttgacactggcaagttaaatatagtagctaaagataacacagggaaggtattaccaatagaagttgatgggtttatagatacaaatagagtaggtacatatatattgacattaaaagctacagacgaatggggaaaaagtacaggaaaaagagtagaaataaaagtgttggatgacaaatctcatgattacaacagcccagaatttaaaaaaatggtatctactgaaatgtataacttaatcaattcctatagaaaagaaaaaggcaaagagcctttggtagtgtctagtaggctagaaggtatggcaaatgcatggtctaagtatatgatggataaaaaagtatttgcacattatatagatggaaaaaatgctccacaagtattttctgagtttggaatgagaagtgaggaaaatatagcatatatttatatagattctaagaacgttcaaactacacaagatgcaaaagacttggcaaaggctatatttgaggtgtggaagaaatctccagagtacaatgcaaacatgcttagtgatgagttttatagtactggatttgggctttatatattatctgatggtcaagtgcatgctactcaagagtttttaaatggcaatgaaggtagcttg

SEQ ID NO: 262 - protein, 533 aa, Clostridium difficile
MKMNKKILSLGLAVSLILVNFKSVNASSVVEKIYGKDRYETAAKIADKQTYETVILVNTEKSLADGLSVSGLSGATKAPILFTQQNKIPADTNRCLKNIKKAYIIGTEDTISKSVEKELDSKNIEVKRIGGEDRLKTSYLIAKEIATIKKVDKVLLTNAYSGEADAMSVSSVATRDGAPIILTDGKSVPFDVKNIQSYCIGSEEIMSNPLVKNTNSVRIEGTDRFETNKNVIDYFFNSADGFYVSDGYQLVDAIAAAPLTKNSPMVLVNDGSDKTVLEGAKNITSVGEINEKVIQQCINASKSNGQPPTITVGSTEVYKGEKFDTGKLNIVAKDNTGKVLPIEVDGFIDTNRVGTYILTLKATDEWGKSTGKRVEIKVLDDKSHDYNSPEFKKMVSTEMYNLINSYRKEKGKEPLVVSSRLEGMANAWSKYMMDKKVFAHYIDGKNAPQVFSEFGMRSEENIAYIYIDSKNVQTTQDAKDLAKAIFEVWKKSPEYNANMLSDEFYSTGFGLYILSDGQVHATQEFLNGNEGSL

SEQ ID NO: 263 - DNA, 1830 bp, Clostridium difficile
atgaaaatatcaaaaaagatagtgtctttgttaactatgacatttttaactgttacattatatggaaatacatctaatgcatctacaaaagatacattaacgggttctggaagatgggaaacagcaataaaaataagtcaagctgggtggacaaagtctgaaagtgctgtcttagtaaatgacaattccatagcagatgctttatcagctactccatttgctaaagcaaaagatgcgccaatattattaactcaaagtaataaattggatagtagaacaaaagcagaattaaaaagacttggtgtgaaaaatgtatatttaataggtggttcaattgcattaagttcagagattgaaaagcaattaaatgcagaaaatataaattttgaaagaatatccggaaatagtagatatgatacttctttaaaattagctgaaaagctagatagggaaaagtctatatctaaaatagtagtagtaaatggagaaaagggtcttgctgatgcagtgagtgttggagctatagctgctcaagaaaacatgccaataatactttctgattcagagaatggaactgaagtagctgataattttatagatagtaaagatatagcaaaatcgtatgtaataggtggtacatattctatttctaattctgtagaaagaagtttaccaaatgcaacaagaatagcaggtagtagtagaagtgagacaaatgcaaaaattatagaagaattttataaagatactgatataaaaaatatttatgtaacaaaagatggtacaaagaataagaatgatttaatagattctttagcagtgggtgtattagcagctaaaaatagttctccaatagtattagcaggaaataagcttgatactactcaaaaagatgttttaaatactaagattatagataaagttactcaaattggtggcttaggtaatgaaaatgttgtagaagatatactagatatacaagaagagactaagtatactgttgaaactattgatgaacttaatgctgctataaaaagagcagatgcaaatgatattataaagtttaaaccagagaaagaaaaaactataaataattcttttagtattgaaactaaaaaaactgttactattgaattagatggaagatatagacaaacaataactttggatatacctaatggaaaatttaataactatgcagaaatagaaggtggagtaaagctaaaaaacataaaaaatgaatcattagttaataaaggaagtatacaggatttagatatatatgatgaaaatggttgtaaaatagagaatgaaagttctggagaaatttggtttgttactatagttgaagaagctaatgatgtatatatagttaatagtggtgatataacaaaaatatcaaataattcttctagtactataataagaaattctggaaatattgatacagttacaggaaaaaaagaacctgcaataagtggaaataaacctaaagtcaatgatacagaaaaagaaactaaagctgctagaggcttaaatcctagggtagaagcatgttctgttcctaaaaaagattatgttatgataacaattcctaattcacctaaagattcaagatataaaatttactatagagtagtttataataaaccttatgcaatggatgttggtgataaaattaatattggagaatggactgttgcaccaacagatgaagagccatttcttgaaaaagctaaaaatggttgttatgtagaagctgttgaggtaaatacttcaacgaaagaggtttctagatggggaagaactaacgctacagatgatggattt

SEQ ID NO: 264 - protein, 610 aa, Clostridium difficile
MKISKKIVSLLTMTFLTVTLYGNTSNASTKDTLTGSGRWETAIKISQAGWTKSESAVLVNDNSIADALSATPFAKAKDAPILLTQSNKLDSRTKAELKRLGVKNVYLIGGSIALSSEIEKQLNAENINFERISGNSRYDTSLKLAEKLDREKSISKIVVVNGEKGLADAVSVGAIAAQENMPIILSDSENGTEVADNFIDSKDIAKSYVIGGTYSISNSVERSLPNATRIAGSSRSETNAKIIEEFYKDTDIKNIYVTKDGTKNKNDLIDSLAVGVLAAKNSSPIVLAGNKLDTTQKDVLNTKIIDKVTQIGGLGNENVVEDILDIQEETKYTVETIDELNAAIKRADANDIIKFKPEKEKTINNSFSIETKKTVTIELDGRYRQTITLDIPNGKFNNYAEIEGGVKLKNIKNESLVNKGSIQDLDIYDENGCKIENESSGEIWFVTIVEEANDVYIVNSGDITKISNNSSSTIIRNSGNIDTVTGKKEPAISGNKPKVNDTEKETKAARGLNPRVEACSVPKKDYVMITIPNSPKDSRYKIYYRVVYNKPYAMDVGDKINIGEWTVAPTDEEPFLEKAKNGCYVEAVEVNTSTKEVSRWGRTNATDDGF

SEQ ID NO: 265 - DNA, 2157 bp, Clostridium difficile
atgaataagaaaaatatagcaatagctatgtcaggtttaacagttttagcttcggctgctcctgtttttgctgcaactactggaacacaaggttatactgtagttaaaaacgactggaaaaaagcagtaaaacaattacaagatggactaaaagataatagtataggaaagataactgtatcttttaatgatggggttgtgggtgaagtagctcctaaaagtgctaataagaaagcggacagagatgctgcagctgagaagttatataatcttgttaacactcaattagataaattaggtgatggagattatgttgatttttctgtagattataatttagaaaacaaaataataactaatcaagcagatgcagaagcaattgttacaaagttaaattcacttaatgagaaaactcttattgatatagcaactaaagatacttttggaatggttagtaaaacacaagatagtgaaggtaaaaatgttgctgcaacaaaggcacttaaagttaaagatgttgctacatttggtttgaagtctggtggaagcgaagatactggatatgttgttgaaatgaaagcaggagctgtagaggataagtatggtaaagttggagatagtacggcaggtattgcaataaatcttcctagtactggacttgaatatgcaggtaaaggaacaacaattgattttaataaaactttaaaagttgatgtaacaggtggttcaacacctagtgctgtagctgtaagtggttttgtaactaaagatgatactgatttagcaaaatcaggtactataaatgtaagagttataaatgcaaaagaagaatcaattgatatagatgcaagctcatatacatcagctgaaaatttagctaaaagatatgtatttgatccagatgaaatttctgaagcatataaggcaatagtagcattacaaaatgatggtatagagtctaatttagttcagttagttaatggaaaatatcaagtgattttttatccagaaggtaaaagattagaaactaaatcagcaaatgatacaatagctagtcaagatacaccagctaaagtagttataaaagctaataaattaaaagatttaaaagattatgtagatgatttaaaaacatataataatacttattcaaatgttgtaacagtagcaggagaagatagaatagaaactgctatagaattaagtagtaaatattataattctgatgataaaaatgcaataactgataaagcagttaatgatatagtattagttggatctacatctatagttgatggtcttgttgcatcaccattagcttcagaaaaaacagctccattattattaacttcaaaagataaattagattcatcagtaaaatctgaaataaagagagttatgaacttaaagagtgacactggtataaatacttctaaaaaagtttatttagctggtggagttaattctatatctaaagatgtagaaaatgaattgaaaaacatgggtcttaaagttactagattatcaggagaagacagatacgaaacttctttagcaatagctgatgaaataggtcttgataatgataaagcatttgtagttggtggtactggattagcagatgctatgagtatagctccagttgcttctcaacttaaagatggagatgctactccaatagtagttgtagatggaaaagcaaaagaaataagtgatgatgctaagagtttcttaggaacttctgatgttgatataataggtggaaaaaatagcgtatctaaagagattgaagagtcaatagatagtgcaactggaaaaactccagatagaataagtggagatgatagacaagcaactaatgctgaagttttaaaagaagatgattatttcacagatggtgaagttgtgaattactttgttgcaaaagatggttctactaaagaagatcaattagtagatgccttagcagcagcaccaatagcaggtagatttaaggagtctccagctccaatcatactagctactgatactttatcttctgaccaaaatgtagctgtaagtaaagcagttcctaaagatggtggaactaacttagttcaagtaggtaaaggtatagcttcttcagttataaacaaaatgaaagatttattagatatg

SEQ ID NO: 266 - protein, 719 aa, Clostridium difficile
MNKKNIAIAMSGLTVLASAAPVFAATTGTQGYTVVKNDWKKAVKQLQDGLKDNSIGKITVSFNDGVVGEVAPKSANKKADRDAAAEKLYNLVNTQLDKLGDGDYVDFSVDYNLENKIITNQADAEAIVTKLNSLNEKTLIDIATKDTFGMVSKTQDSEGKNVAATKALKVKDVATFGLKSGGSEDTGYVVEMKAGAVEDKYGKVGDSTAGIAINLPSTGLEYAGKGTTIDFNKTLKVDVTGGSTPSAVAVSGFVTKDDTDLAKSGTINVRVINAKEESIDIDASSYTSAENLAKRYVFDPDEISEAYKAIVALQNDGIESNLVQLVNGKYQVIFYPEGKRLETKSANDTIASQDTPAKVVIKANKLKDLKDYVDDLKTYNNTYSNVVTVAGEDRIETAIELSSKYYNSDDKNAITDKAVNDIVLVGSTSIVDGLVASPLASEKTAPLLLTSKDKLDSSVKSEIKRVMNLKSDTGINTSKKVYLAGGVNSISKDVENELKNMGLKVTRLSGEDRYETSLAIADEIGLDNDKAFVVGGTGLADAMSIAPVASQLKDGDATPIVVVDGKAKEISDDAKSFLGTSDVDIIGGKNSVSKEIEESIDSATGKTPDRISGDDRQATNAEVLKEDDYFTDGEVVNYFVAKDGSTKEDQLVDALAAAPIAGRFKESPAPIILATDTLSSDQNVAVSKAVPKDGGTNLVQVGKGIASSVINKMKDLLDM

SEQ ID NO: 267 - DNA, 1947 bp, Clostridium difficile
gctgaaaatactactgcaaatacagaatctaattcagatattaatataaatttacaaagaaaaagtgtagtgttaggaagtaaatctaatgcaagtgtaaaatttaaagaaaaattaaatgctgattcaataacattaaattttatgtgttatgatatgccacttgaagctactttaaattacaatgaaaagacagattcatatgaaggtgtaataaactataacaaagacccagaatacttaaatgtatgggaacttcaaagcataaaaataaatggtaaagatgaacagaaagttttaaacaaagaagacttagagtctatgggattaaatcttaaggattatgatgttacacaagagtttataataagtgatgcaaattcaacaaaagcagtaaatgaatatatgagaaaaacttctgcaccagtaaaaaaacttgctggagctactagatttgaaactgctgttgagataagtaaacagggttggaaagatgggtctagtaaggttgtaatagttaatggagaattagcagcagatggaattacagctactccacttgcatctacatatgacgcaccaatattacttgcaaataaagatgatataccagaaagtacaaaagcagagttaaaacgtctaaatccaagtgatgtaataattataggtgatgatggttcagtttcacaaaaggcagtgtctcaaattaaatctgctgtaaatgtaaatgtgactcgtattggtggagttgatagacatgaaacatctttacttatagcaaaagaaatagataagtatcatgatgttaataaaatatacatagcaaatggatatgctggtgaatatgatgctcttaatatttcatcaaaagctggtgaagaccaacaacctataatattagctaataaagattctgtaccacaaggtacatataattggttatcttcacaaggtttagaagaagcttattacataggtggtagtcaaagtttatcatcaaaaattatagaccaaatatctaaaatagcaaaaaatggtacttcaaaaaatagagtttctggagcagatagacatgaaacaaatgcaaatgtaattaagactttctatccagataaagagttgagtgcaatgttagttgcaaaatctgacataatagttgattcaataacagcaggacctttagcagctaaattaaaagctccaatacttataactccaaaaacttatgtttctgcataccatagtacaaacttatcagaaaaaacagcagaaacagtatatcaaattggtgatggaatgaaagatagtgttataaattctatagcatctagtttatcaaaacacaatgcaccaacagaaccagataattcaggttcagcagcaggaaaaactgtagtgatagacccaggtcatgggggttctgattcaggggcaacaagtggattaaatggtggagcacaagaaaagaaatatactcttaatacagcattagcaactactgaatatttacgttcaaaaggtataaatgttgttatgactagagatacagataaaacaatggctttaggagaaagaacagcattatcaaatactataaagccagatttatttacaagtatacattacaatgcgtctaatggatctggtaatggtgtggaaatttattacaaagtaaaagataaaaatggtggaacaactaagactgcagcatcaaatatcttaaaaagaatactagaaaaatttaacatgaaaaatagaggaatcaagacaagaacacttgataatggaaaagattacctatatgtgttaagaaataacaattatccagcaatacttgttgaatgtgcatttattgacaataagagcgatatggataagttaaatactgcagaaaaagtaaaaacaatgggaactcaaattggaataggaatagaagatacagtaaaa

SEQ ID NO: 268 - protein, 649 aa, Clostridium difficile
AENTTANTESNSDININLQRKSVVLGSKSNASVKFKEKLNADSITLNFMCYDMPLEATLNYNEKTDSYEGVINYNKDPEYLNVWELQSIKINGKDEQKVLNKEDLESMGLNLKDYDVTQEFIISDANSTKAVNEYMRKTSAPVKKLAGATRFETAVEISKQGWKDGSSKVVIVNGELAADGITATPLASTYDAPILLANKDDIPESTKAELKRLNPSDVIIIGDDGSVSQKAVSQIKSAVNVNVTRIGGVDRHETSLLIAKEIDKYHDVNKIYIANGYAGEYDALNISSKAGEDQQPIILANKDSVPQGTYNWLSSQGLEEAYYIGGSQSLSSKIIDQISKIAKNGTSKNRVSGADRHETNANVIKTFYPDKELSAMLVAKSDIIVDSITAGPLAAKLKAPILITPKTYVSAYHSTNLSEKTAETVYQIGDGMKDSVINSIASSLSKHNAPTEPDNSGSAAGKTVVIDPGHGGSDSGATSGLNGGAQEKKYTLNTALATTEYLRSKGINVVMTRDTDKTMALGERTALSNTIKPDLFTSIHYNASNGSGNGVEIYYKVKDKNGGTTKTAASNILKRILEKFNMKNRGIKTRTLDNGKDYLYVLRNNNYPAILVECAFIDNKSDMDKLNTAEKVKTMGTQIGIGIEDTVK

SEQ ID NO: 269 - DNA, 1599 bp, Clostridium difficile; identical to SEQ ID NO: 261

SEQ ID NO: 270 - protein, 533 aa, Clostridium difficile; identical to SEQ ID NO: 262

SEQ ID NO: 271 - DNA, 1770 bp, Clostridium difficile
tatggaaatacatctaatgcatctacaaaagatacattaacgggttctggaagatgggaaacagcaataaaaataagtcaagctgggtggacaaagtctgaaagtgctgtcttagtaaatgacaattccatagcagatgctttatcagctactccatttgctaaagcaaaagatgcgccaatattattaactcaaagtaataaattggatagtagaacaaaagcagaattaaaaagacttggtgtgaaaaatgtatatttaataggtggttcaattgcattaagttcagagattgaaaagcaattaaatgcagaaaatataaattttgaaagaatatccggaaatagtagatatgatacttctttaaaattagctgaaaagctagatagggaaaagtctatatctaaaatagtagtagtaaatggagaaaagggtcttgctgatgcagtgagtgttggagctatagctgctcaagaaaacatgccaataatactttctgattcagagaatggaactgaagtagctgataattttatagatagtaaagatatagcaaaatcgtatgtaataggtggtacatattctatttctaattctgtagaaagaagtttaccaaatgcaacaagaatagcaggtagtagtagaagtgagacaaatgcaaaaattatagaagaattttataaagatactgatataaaaaatatttatgtaacaaaagatggtacaaagaataagaatgatttaatagattctttagcagtgggtgtattagcagctaaaaatagttctccaatagtattagcaggaaataagcttgatactactcaaaaagatgttttaaatactaagattatagataaagttactcaaattggtggcttaggtaatgaaaatgttgtagaagatatactagatatacaagaagagactaagtatactgttgaaactattgatgaacttaatgctgctataaaaagagcagatgcaaatgatattataaagtttaaaccagagaaagaaaaaactataaataattcttttagtattgaaactaaaaaaactgttactattgaattagatggaagatatagacaaacaataactttggatatacctaatggaaaatttaataactatgcagaaatagaaggtggagtaaagctaaaaaacataaaaaatgaatcattagttaataaaggaagtatacaggatttagatatatatgatgaaaatggttgtaaaatagagaatgaaagttctggagaaatttggtttgttactatagttgaagaagctaatgatgtatatatagttaatagtggtgatataacaaaaatatcaaataattcttctagtactataataagaaattctggaaatattgatacagttacaggaaaaaaagaacctgcaataagtggaaataaacctaaagtcaatgatacagaaaaagaaactaaagctgctagaggcttaaatcctagggtagaagcatgttctgttcctaaaaaagattatgttatgataacaattcctaattcacctaaagattcaagatataaaatttactatagagtagtttataataaaccttatgcaatggatgttggtgataaaattaatattggagaatggactgttgcaccaacagatgaagagccatttcttgaaaaagctaaaaatggttgttatgtagaagctgttgaggtaaatacttcaacgaaagaggtttctagatggggaagaactaacgctacagatgatggattt

SEQ ID NO: 272 - protein, 590 aa, Clostridium difficile
YGNTSNASTKDTLTGSGRWETAIKISQAGWTKSESAVLVNDNSIADALSATPFAKAKDAPILLTQSNKLDSRTKAELKRLGVKNVYLIGGSIALSSEIEKQLNAENINFERISGNSRYDTSLKLAEKLDREKSISKIVVVNGEKGLADAVSVGAIAAQENMPIILSDSENGTEVADNFIDSKDIAKSYVIGGTYSISNSVERSLPNATRIAGSSRSETNAKIIEEFYKDTDIKNIYVTKDGTKNKNDLIDSLAVGVLAAKNSSPIVLAGNKLDTTQKDVLNTKIIDKVTQIGGLGNENVVEDILDIQEETKYTVETIDELNAAIKRADANDIIKFKPEKEKTINNSFSIETKKTVTIELDGRYRQTITLDIPNGKFNNYAEIEGGVKLKNIKNESLVNKGSIQDLDIYDENGCKIENESSGEIWFVTIVEEANDVYIVNSGDITKISNNSSSTIIRNSGNIDTVTGKKEPAISGNKPKVNDTEKETKAARGLNPRVEACSVPKKDYVMITIPNSPKDSRYKIYYRVVYNKPYAMDVGDKINIGEWTVAPTDEEPFLEKAKNGCYVEAVEVNTSTKEVSRWGRTNATDDGF

SEQ ID NO: 273 - DNA, 2085 bp, Clostridium difficile
gcaactactggaacacaaggttatactgtagttaaaaacgactggaaaaaagcagtaaaacaattacaagatggactaaaagataatagtataggaaagataactgtatcttttaatgatggggttgtgggtgaagtagctcctaaaagtgctaataagaaagcggacagagatgctgcagctgagaagttatataatcttgttaacactcaattagataaattaggtgatggagattatgttgatttttctgtagattataatttagaaaacaaaataataactaatcaagcagatgcagaagcaattgttacaaagttaaattcacttaatgagaaaactcttattgatatagcaactaaagatacttttggaatggttagtaaaacacaagatagtgaaggtaaaaatgttgctgcaacaaaggcacttaaagttaaagatgttgctacatttggtttgaagtctggtggaagcgaagatactggatatgttgttgaaatgaaagcaggagctgtagaggataagtatggtaaagttggagatagtacggcaggtattgcaataaatcttcctagtactggacttgaatatgcaggtaaaggaacaacaattgattttaataaaactttaaaagttgatgtaacaggtggttcaacacctagtgctgtagctgtaagtggttttgtaactaaagatgatactgatttagcaaaatcaggtactataaatgtaagagttataaatgcaaaagaagaatcaattgatatagatgcaagctcatatacatcagctgaaaatttagctaaaagatatgtatttgatccagatgaaatttctgaagcatataaggcaatagtagcattacaaaatgatggtatagagtctaatttagttcagttagttaatggaaaatatcaagtgattttttatccagaaggtaaaagattagaaactaaatcagcaaatgatacaatagctagtcaagatacaccagctaaagtagttataaaagctaataaattaaaagatttaaaagattatgtagatgatttaaaaacatataataatacttattcaaatgttgtaacagtagcaggagaagatagaatagaaactgctatagaattaagtagtaaatattataattctgatgataaaaatgcaataactgataaagcagttaatgatatagtattagttggatctacatctatagttgatggtcttgttgcatcaccattagcttcagaaaaaacagctccattattattaacttcaaaagataaattagattcatcagtaaaatctgaaataaagagagttatgaacttaaagagtgacactggtataaatacttctaaaaaagtttatttagctggtggagttaattctatatctaaagatgtagaaaatgaattgaaaaacatgggtcttaaagttactagattatcaggagaagacagatacgaaacttctttagcaatagctgatgaaataggtcttgataatgataaagcatttgtagttggtggtactggattagcagatgctatgagtatagctccagttgcttctcaacttaaagatggagatgctactccaatagtagttgtagatggaaaagcaaaagaaataagtgatgatgctaagagtttcttaggaacttctgatgttgatataataggtggaaaaaatagcgtatctaaagagattgaagagtcaatagatagtgcaactggaaaaactccagatagaataagtggagatgatagacaagcaactaatgctgaagttttaaaagaagatgattatttcacagatggtgaagttgtgaattactttgttgcaaaagatggttctactaaagaagatcaattagtagatgccttagcagcagcaccaatagcaggtagatttaaggagtctccagctccaatcatactagctactgatactttatcttctgaccaaaatgtagctgtaagtaaagcagttcctaaagatggtggaactaacttagttcaagtaggtaaaggtatagcttcttcagttataaacaaaatgaaagatttattagatatg

SEQ ID NO: 274 - protein, 695 aa, Clostridium difficile
ATTGTQGYTVVKNDWKKAVKQLQDGLKDNSIGKITVSFNDGVVGEVAPKSANKKADRDAAAEKLYNLVNTQLDKLGDGDYVDFSVDYNLENKIITNQADAEAIVTKLNSLNEKTLIDIATKDTFGMVSKTQDSEGKNVAATKALKVKDVATFGLKSGGSEDTGYVVEMKAGAVEDKYGKVGDSTAGIAINLPSTGLEYAGKGTTIDFNKTLKVDVTGGSTPSAVAVSGFVTKDDTDLAKSGTINVRVINAKEESIDIDASSYTSAENLAKRYVFDPDEISEAYKAIVALQNDGIESNLVQLVNGKYQVIFYPEGKRLETKSANDTIASQDTPAKVVIKANKLKDLKDYVDDLKTYNNTYSNVVTVAGEDRIETAIELSSKYYNSDDKNAITDKAVNDIVLVGSTSIVDGLVASPLASEKTAPLLLTSKDKLDSSVKSEIKRVMNLKSDTGINTSKKVYLAGGVNSISKDVENELKNMGLKVTRLSGEDRYETSLAIADEIGLDNDKAFVVGGTGLADAMSIAPVASQLKDGDATPIVVVDGKAKEISDDAKSFLGTSDVDIIGGKNSVSKEIEESIDSATGKTPDRISGDDRQATNAEVLKEDDYFTDGEVVNYFVAKDGSTKEDQLVDALAAAPIAGRFKESPAPIILATDTLSSDQNVAVSKAVPKDGGTNLVQVGKGIASSVINKMKDLLDM

SEQ ID NO: 275 - DNA, 23 bp, Artificial Sequence
  Primer
gctgaaaatactactgcaaatac

SEQ ID NO: 276 - DNA, 26 bp, Artificial Sequence
  Primer
ttttactgtatcttctattcctattc

SEQ ID NO: 277 - DNA, 23 bp, Artificial Sequence
  Primer
aacttcaaaagtgtaaatgcatc

SEQ ID NO: 278 - DNA, 18 bp, Artificial Sequence
  Primer
caagctaccttcattgcc

SEQ ID NO: 279 - DNA, 23 bp, Artificial Sequence
  Primer
tatggaaatacatctaatgcatc

SEQ ID NO: 280 - DNA, 23 bp, Artificial Sequence
  Primer
aaatccatcatctgtagcgttag

SEQ ID NO: 281 - DNA, 20 bp, Artificial Sequence
  Primer
gcaactactggaacacaagg

SEQ ID NO: 282 - DNA, 28 bp, Artificial Sequence
  Primer
catatctaataaatctttcattttgttt

SEQ ID NO: 283 - DNA, 1020 bp, Clostridium difficile
gtgaagaaaaagatattaataccagtatttgcatcagttatggcattatcagtaagttcaattgtaaatgcagatgaagtaaatgattcatctcaaaataaggatgataaaacaaatactgaattaaatttaggtgaatataaagaagtaaaatataaagttgcaaaaataaaagatggagtagctataaagataagagaagaaggtcaagttcaaaacatagcttattctggagatgaatttacggttttaggaactcaaggagaatgggttaaggttaaagttgaagatggcgaaggttggttagctactagatatgtagatatatctgaaggtgtaggatatactaacgctgataaagtaaacttaagaaaagataagagtgaaagttcagaagtaattgaagagctggaaaaaggaagttctttattggttttggaagataatggagattggttaaaagttaaagatggggaaacagaaggatatgtaaaatcatcttatatatctgataaagctcctgtaatagaagagccacaagtaaacccaagtattgaccaaaatgtagattctacaaataataatcaacaaaacaatgcaaatactaatcaacaaaataataattcaaatgtgccaacagctaactctaatgcagttcaagctgtacttaacttggcatattctaagcaaggttgtccatatgtttggggagcagaaggaccaaacacttttgactgttctggatttacacaatatgtgtatagaaatgcagtaggaaagaatataccaagaacatctaaagcacaatctaaatatggacaaactgtaagtaaagcaaatttacaaccaggagacttagtattcttcacaactaatggttctggttctgttagtcatgttggaatatatgtaggtgggggtaatatgatacattcaccatcaacaggaaaaacagttagtgtaactagtataaattcatcatactatacagcaagatttgttacagcaaaaagaatatta

SEQ ID NO: 284 - protein, 340 aa, Clostridium difficile
MKKKILIPVFASVMALSVSSIVNADEVNDSSQNKDDKTNTELNLGEYKEVKYKVAKIKDGVAIKIREEGQVQNIAYSGDEFTVLGTQGEWVKVKVEDGEGWLATRYVDISEGVGYTNADKVNLRKDKSESSEVIEELEKGSSLLVLEDNGDWLKVKDGETEGYVKSSYISDKAPVIEEPQVNPSIDQNVDSTNNNQQNNANTNQQNNNSNVPTANSNAVQAVLNLAYSKQGCPYVWGAEGPNTFDCSGFTQYVYRNAVGKNIPRTSKAQSKYGQTVSKANLQPGDLVFFTTNGSGSVSHVGIYVGGGNMIHSPSTGKTVSVTSINSSYYTARFVTAKRIL

SEQ ID NO: 285 - DNA, 1680 bp, Clostridium difficile
ttgaagaggaacttcaatatgatgtttaaaatatttaataaaagtctattaaaattagtagttgtattatcaatagtactgacaatatcaaattttagcttatcttcatatgcatcagaaattacttccagcacagataaggtattaatcatatatgattctaagaaagaaacagcttataatagagatattttaaatattatgaggactctattgggaagatttagttcagatatagagctattaaaattgagtaactatgatggtgagataaataaaaattattacagtcatatatttattttaggaatcaatgaaaactcatataataatgataaaaacactaaaaacttgattagttccttaaattcatataaaggaactatatgttggttaggatatggtatagaaaatcttttggaacataaaaaatacaatttagactatgtaggaaaaacaaacaatatagttagtgtaaattatagaggtaaatcatataacttggatgaacattatgtttttaacattgtagaatcaaaagatacaagtaataaagtaataggaagtattaatgataccttaaataagtatccatatataataaatgataaaaatcttttttatgtatcaaaattagatttagatggagttttattttatatattttgcgattcacttaatgatatttttaatattaagacgtttgataaaggacgtatatttgtaagaatagaagatgtacatgcttttagagaaccaaaaaatcttgtagagatagcggattatttaagtagtaagaatataccatttacgattgcattaataccagcatatgtaaatcctaaaaatcataaggtaataactttatcagaaagccctgaaattgtcaaagcaataaaatatatgcaagataaaggtggaactgtgatattgcatggatatactcatcaatacaagaaagaagaagtttctggagaagggtatgaattttgggatggtaaaaaagatgaacccttaaaagaaaatatgaagatatttgtcaaagatagagttttgaatggtcttagagtatgtatagagaatggaatttatcctcttgcatttgaagcgccacattatgcaatggaatcagagggatataaagaattaaaaaaatatttttctacttatatggggcaacatcaaaataatgataaaaaatttagcacaaatacatatccttatattattagggatacagaagagtttaatatatttatacccgaaaatttaggatatatagacccagaagataagtttacttttcaaaatataaaagaaaatttagataaattatccattgtaagaggttttagtggagggttcttctttcattcatatttaaacatagagtatctaaaaaacacaatagaatatttagaaaaacagaatatagaatttatgaatttaagagattttaataattgggtaaaagttgatgaaatacaaataagaaatagtggagatgaaattatagtcaactatgataaggacttagatgaaataactaaaagtgatactagatttaaatccatatccaatattagtaaagttttaatattcatagtatctataagtgttttaatatttgtgattatatttatatattttaagagaatagataaaaagaaatttttaaaa

SEQ ID NO: 286 - protein, 560 aa, Clostridium difficile
MKRNFNMMFKIFNKSLLKLVVVLSIVLTISNFSLSSYASEITSSTDKVLIIYDSKKETAYNRDILNIMRTLLGRFSSDIELLKLSNYDGEINKNYYSHIFILGINENSYNNDKNTKNLISSLNSYKGTICWLGYGIENLLEHKKYNLDYVGKTNNIVSVNYRGKSYNLDEHYVFNIVESKDTSNKVIGSINDTLNKYPYIINDKNLFYVSKLDLDGVLFYIFCDSLNDIFNIKTFDKGRIFVRIEDVHAFREPKNLVEIADYLSSKNIPFTIALIPAYVNPKNHKVITLSESPEIVKAIKYMQDKGGTVILHGYTHQYKKEEVSGEGYEFWDGKKDEPLKENMKIFVKDRVLNGLRVCIENGIYPLAFEAPHYAMESEGYKELKKYFSTYMGQHQNNDKKFSTNTYPYIIRDTEEFNIFIPENLGYIDPEDKFTFQNIKENLDKLSIVRGFSGGFFFHSYLNIEYLKNTIEYLEKQNIEFMNLRDFNNWVKVDEIQIRNSGDEIIVNYDKDLDEITKSDTRFKSISNISKVLIFIVSISVLIFVIIFIYFKRIDKKKFLK

SEQ ID NO: 287 - DNA, 1050 bp, Clostridium difficile
ttgaaaattaaatctaaaaaaataatagcatttgcactttcacttgggattatgttgccaagttgtgtatatgcagacactattagtaaaaatcaaaatgcacaggtagatatgaacaattatcttcaaggtagaaaatctccaaaggaggaaaaacttattggtgaagatagatttgatacagcgataaaaatatctcaaagtggttggaataatggttcagaaagggtgtttctagttaactcaaattcattgccagatgcattggcttcaactcctttggcaagtaaattggatgcaccaatactgcttacaaataaaaatagtataccatataatgtaacagaggaaataaaaaggcttaatccagcagaagttattttaattggaagtgaaggagctatttcatcaagtgtaaaagaatctcttgaagatatggaagtattagtcagtagaatcggtggagcagatagagaagaaacatctttacttcttactagacagctagatgatactggtgatttaggtgtctcaaaagtggcagtggttaatgggtataatggactggcagatgcaacttcaatatcaagcccagctgcaagtgataatacagctataatatatacaggtaaggatagcataagaagtgaggcaaagaattttattacacaaaactcaactaagacatacatagtaggtggggagtacagtataagtaaaaaacttgaaggacagttagtaaactcagaaagactagcagggacagatagaaaagatactaatgcgaaagttttagaaaagttttatggaaaatcaagtaaggttaataatatgtattttgcaaaagatggaagtggtagagaagctgatttagttgatgggcttgctgctggagtattagcatcaaaaacaaagtcacctgtagtacttgcaagtggaagtttaagtagtgcacagaaaagttttataaaaaaagtaaaggctgataaatttgtacaagttggtggaggtaaaaatagtaaaccatatgcagaagcattagccttacag

SEQ ID NO: 288 - protein, 350 aa, Clostridium difficile
MKIKSKKIIAFALSLGIMLPSCVYADTISKNQNAQVDMNNYLQGRKSPKEEKLIGEDRFDTAIKISQSGWNNGSERVFLVNSNSLPDALASTPLASKLDAPILLTNKNSIPYNVTEEIKRLNPAEVILIGSEGAISSSVKESLEDMEVLVSRIGGADREETSLLLTRQLDDTGDLGVSKVAVVNGYNGLADATSISSPAASDNTAIIYTGKDSIRSEAKNFITQNSTKTYIVGGEYSISKKLEGQLVNSERLAGTDRKDTNAKVLEKFYGKSSKVNNMYFAKDGSGREADLVDGLAAGVLASKTKSPVVLASGSLSSAQKSFIKKVKADKFVQVGGGKNSKPYAEALALQ

SEQ ID NO: 289 - DNA, 3024 bp, Clostridium difficile
atgtttaagcaaaggctctctaaattattatctagtacattagtattgagtatgttatttactgctgctccaaatattacttttgctgataatacaaaagataattccgaaaaatatcaaagttctgatatagaattacatgattatagtaaaaacgcggaatcttacacaaaaactaaagctcttgctaaagagaaaattcaaactttgctatcaaagtatggtgctgtaagtgctcaatatgctttgattgataatggcaaaattgagatttctggtaatggtggagtttacagcaaacaggataacaaaaacttaaataaggataatatgtatagtatcgcatctatcagtaaaatgtttactacaacagctgttatgaagttggttgatgatggaaaattaaatttagatactcctgttgtaaagtatatacctgaatttaaaatggctgatgatagatacaaggaaatcactccaagaatgttattaaatcattcatcagggttgatgggaagtagttttaaaaacactattttattagcagacaatgattcttatggtcatgataatttcttaaaagaattacaaaaacaaagattaaaagctaaaccaggagctttttctgtttattgtaatgatggatttactttagctgaaattttagtagaaagagtatctggtatgtcatttactaattttcttgataaatacataaataatccacttaacttacaaaatacaaaaactccagaaaatagttttgatagttcaaaactagcaaaagcatacgtaccttattgggaagatgcagttccgcaagataaccttaatgctataggtgcaggtggtttatattcaagtgcagaaaatctatgtacatttgcacaaacatttatgaaaaattcaaatggtattctttctcctgcttcagtaaaagctatggaaaacaaagaatatttaaatggtctatggcctgaaggagaagattctatacttggatatggtttaggttgggattgtgtcaacacttatccatttaatcagtataatttaaaagctcttacaaaaggtggagactctttattattccacagtaatcttatagttcttccagatgaaaatatggcagttgcagttctttcttctggtggaagtagtcaacttaacgaaataattggacaagaaatcttactatctgcattaaaagaaaaaggtaaaattaaagaaataaaacctgataaaacatttagtaaaccacaacaagttaaaatgcctagctctctaaaagaaaatagtggtctttatgcttcttcaaatatgataaaagtagatgttaatgataatggtactttaacagtatcttctccttatatagaaaatggacctgaagataaatacgtatacataggtcaagatagatttgtatctgaaaaaggtaacagctgtctaaaatttgtaaaagaaaaaaacaatatcacatatttaaatatgagctcttatgatgatgtccctggattaggtcagacagcaagtttatactatgtagctcaaaagatagatgacaacaatatatcaaatagtgtaaaagaagcatggaaaaaaagaaatggtaaagattactatctagtagatgaaaaatatacttctcaaagctatatgtttggttctgtgaaggcaactcttgctctttctgatgaaactccaggttatatagttaacactaaaataatggatgagaataactcaaatgcttttatagaaatacctggtgtaataggtcgtgatttatccgacattaaacttcataaagaaaatggtacagagtatttatcttttggaacactaacgtatgttagtgaagattctataactaatttgccagcagaaaaatcttttacttgtgaactagaatccaatggttatgcaaaatggtataagattggtgacgatatcgcaaataaaaaaatagaagttaatcttcctcaaaattcatcttttgctgtttatgatgataaaggtgttcctgtaaactattctttagttacaaagaacaatagagttagattgccaaaaggaggcgtaattgttttcttaggaagtccaaatgctagatttgaggttacatatcaagatgaagtaaatgcaagtgcacttacaggaactgatagatatgaaacttctattaagataagtcaagcaggttgggaaaatgctgaaaatgcagttttaataaacgattcagcaattgcagatgctttggctgcaacaccatttgcatacaagaaaaacgctcctatattattgactggaagctctcaaataaatgaaaaaactttggctgaattaaagagattaaaagttaaaaatgtatatgtagttggtggagaggcttctataaatgaaaaatctttagatactataaaatcaaacaatatctctgtatctagaatttcaggaagtgatagatatcaaacttctatgaacattgctaaagaattgaacaatattagcaatatatcaaagatttcagtagttaatggcgaaaaaggattagccgatgcagtaagcattggagctgtatcagctcaaaatgatatgcctataatacttactaatgaaaatagtaatataactgaaataaataacttgtttaaaaacaaaaagattgataaatcttatgtaatcggtggagaatatacagtttctaaaaatatagaaagtaaacttcaaaatccacagagaatatcaggtagcactagaaatgaaactaatgcaaaagtaataaaagaattttacaaggattctaagatagacaatttatatgttgctaaaaatggaatgaataaacaagatgatttaatagacggattatctgttggagttttggctggaaaaactaaatctcctgtaatgctagtaggaaactcactagattataatcaaaaagaactatttaaaactatgagatttaaatctgtaacacaaattggtggaaatggaaatgaaaactcatttaagtaa

SEQ ID NO: 290 - protein, 1007 aa, Clostridium difficile
MFKQRLSKLLSSTLVLSMLFTAAPNITFADNTKDNSEKYQSSDIELHDYSKNAESYTKTKALAKEKIQTLLSKYGAVSAQYALIDNGKIEISGNGGVYSKQDNKNLNKDNMYSIASISKMFTTTAVMKLVDDGKLNLDTPVVKYIPEFKMADDRYKEITPRMLLNHSSGLMGSSFKNTILLADNDSYGHDNFLKELQKQRLKAKPGAFSVYCNDGFTLAEILVERVSGMSFTNFLDKYINNPLNLQNTKTPENSFDSSKLAKAYVPYWEDAVPQDNLNAIGAGGLYSSAENLCTFAQTFMKNSNGILSPASVKAMENKEYLNGLWPEGEDSILGYGLGWDCVNTYPFNQYNLKALTKGGDSLLFHSNLIVLPDENMAVAVLSSGGSSQLNEIIGQEILLSALKEKGKIKEIKPDKTFSKPQQVKMPSSLKENSGLYASSNMIKVDVNDNGTLTVSSPYIENGPEDKYVYIGQDRFVSEKGNSCLKFVKEKNNITYLNMSSYDDVPGLGQTASLYYVAQKIDDNNISNSVKEAWKKRNGKDYYLVDEKYTSQSYMFGSVKATLALSDETPGYIVNTKIMDENNSNAFIEIPGVIGRDLSDIKLHKENGTEYLSFGTLTYVSEDSITNLPAEKSFTCELESNGYAKWYKIGDDIANKKIEVNLPQNSSFAVYDDKGVPVNYSLVTKNNRVRLPKGGVIVFLGSPNARFEVTYQDEVNASALTGTDRYETSIKISQAGWENAENAVLINDSAIADALAATPFAYKKNAPILLTGSSQINEKTLAELKRLKVKNVYVVGGEASINEKSLDTIKSNNISVSRISGSDRYQTSMNIAKELNNISNISKISVVNGEKGLADAVSIGAVSAQNDMPIILTNENSNITEINNLFKNKKIDKSYVIGGEYTVSKNIESKLQNPQRISGSTRNETNAKVIKEFYKDSKIDNLYVAKNGMNKQDDLIDGLSVGVLAGKTKSPVMLVGNSLDYNQKELFKTMRFKSVTQIGGNGNENSFK

SEQ ID NO: 291 - DNA, 2058 bp, Clostridium difficile
gataatacaaaagataattccgaaaaatatcaaagttctgatatagaattacatgattatagtaaaaacgcggaatcttacacaaaaactaaagctcttgctaaagagaaaattcaaactttgctatcaaagtatggtgctgtaagtgctcaatatgctttgattgataatggcaaaattgagatttctggtaatggtggagtttacagcaaacaggataacaaaaacttaaataaggataatatgtatagtatcgcatctatcagtaaaatgtttactacaacagctgttatgaagttggttgatgatggaaaattaaatttagatactcctgttgtaaagtatatacctgaatttaaaatggctgatgatagatacaaggaaatcactccaagaatgttattaaatcattcatcagggttgatgggaagtagttttaaaaacactattttattagcagacaatgattcttatggtcatgataatttcttaaaagaattacaaaaacaaagattaaaagctaaaccaggagctttttctgtttattgtaatgatggatttactttagctgaaattttagtagaaagagtatctggtatgtcatttactaattttcttgataaatacataaataatccacttaacttacaaaatacaaaaactccagaaaatagttttgatagttcaaaactagcaaaagcatacgtaccttattgggaagatgcagttccgcaagataaccttaatgctataggtgcaggtggtttatattcaagtgcagaaaatctatgtacatttgcacaaacatttatgaaaaattcaaatggtattctttctcctgcttcagtaaaagctatggaaaacaaagaatatttaaatggtctatggcctgaaggagaagattctatacttggatatggtttaggttgggattgtgtcaacacttatccatttaatcagtataatttaaaagctcttacaaaaggtggagactctttattattccacagtaatcttatagttcttccagatgaaaatatggcagttgcagttctttcttctggtggaagtagtcaacttaacgaaataattggacaagaaatcttactatctgcattaaaagaaaaaggtaaaattaaagaaataaaacctgataaaacatttagtaaaccacaacaagttaaaatgcctagctctctaaaagaaaatagtggtctttatgcttcttcaaatatgataaaagtagatgttaatgataatggtactttaacagtatcttctccttatatagaaaatggacctgaagataaatacgtatacataggtcaagatagatttgtatctgaaaaaggtaacagctgtctaaaatttgtaaaagaaaaaaacaatatcacatatttaaatatgagctcttatgatgatgtccctggattaggtcagacagcaagtttatactatgtagctcaaaagatagatgacaacaatatatcaaatagtgtaaaagaagcatggaaaaaaagaaatggtaaagattactatctagtagatgaaaaatatacttctcaaagctatatgtttggttctgtgaaggcaactcttgctctttctgatgaaactccaggttatatagttaacactaaaataatggatgagaataactcaaatgcttttatagaaatacctggtgtaataggtcgtgatttatccgacattaaacttcataaagaaaatggtacagagtatttatcttttggaacactaacgtatgttagtgaagattctataactaatttgccagcagaaaaatcttttacttgtgaactagaatccaatggttatgcaaaatggtataagattggtgacgatatcgcaaataaaaaaatagaagttaatcttcctcaaaattcatcttttgctgtttatgatgataaaggtgttcctgtaaactattctttagttacaaagaacaatagagttagattgccaaaaggaggcgtaattgttttcttaggaagtccaaatgctagatttgaggttacatatcaagatgaagtaaat

SEQ ID NO: 292 - protein, 686 aa, Clostridium difficile
DNTKDNSEKYQSSDIELHDYSKNAESYTKTKALAKEKIQTLLSKYGAVSAQYALIDNGKIEISGNGGVYSKQDNKNLNKDNMYSIASISKMFTTTAVMKLVDDGKLNLDTPVVKYIPEFKMADDRYKEITPRMLLNHSSGLMGSSFKNTILLADNDSYGHDNFLKELQKQRLKAKPGAFSVYCNDGFTLAEILVERVSGMSFTNFLDKYINNPLNLQNTKTPENSFDSSKLAKAYVPYWEDAVPQDNLNAIGAGGLYSSAENLCTFAQTFMKNSNGILSPASVKAMENKEYLNGLWPEGEDSILGYGLGWDCVNTYPFNQYNLKALTKGGDSLLFHSNLIVLPDENMAVAVLSSGGSSQLNEIIGQEILLSALKEKGKIKEIKPDKTFSKPQQVKMPSSLKENSGLYASSNMIKVDVNDNGTLTVSSPYIENGPEDKYVYIGQDRFVSEKGNSCLKFVKEKNNITYLNMSSYDDVPGLGQTASLYYVAQKIDDNNISNSVKEAWKKRNGKDYYLVDEKYTSQSYMFGSVKATLALSDETPGYIVNTKIMDENNSNAFIEIPGVIGRDLSDIKLHKENGTEYLSFGTLTYVSEDSITNLPAEKSFTCELESNGYAKWYKIGDDIANKKIEVNLPQNSSFAVYDDKGVPVNYSLVTKNNRVRLPKGGVIVFLGSPNARFEVTYQDEVN

SEQ ID NO: 293 - DNA, 879 bp, Clostridium difficile
aatgcaagtgcacttacaggaactgatagatatgaaacttctattaagataagtcaagcaggttgggaaaatgctgaaaatgcagttttaataaacgattcagcaattgcagatgctttggctgcaacaccatttgcatacaagaaaaacgctcctatattattgactggaagctctcaaataaatgaaaaaactttggctgaattaaagagattaaaagttaaaaatgtatatgtagttggtggagaggcttctataaatgaaaaatctttagatactataaaatcaaacaatatctctgtatctagaatttcaggaagtgatagatatcaaacttctatgaacattgctaaagaattgaacaatattagcaatatatcaaagatttcagtagttaatggcgaaaaaggattagccgatgcagtaagcattggagctgtatcagctcaaaatgatatgcctataatacttactaatgaaaatagtaatataactgaaataaataacttgtttaaaaacaaaaagattgataaatcttatgtaatcggtggagaatatacagtttctaaaaatatagaaagtaaacttcaaaatccacagagaatatcaggtagcactagaaatgaaactaatgcaaaagtaataaaagaattttacaaggattctaagatagacaatttatatgttgctaaaaatggaatgaataaacaagatgatttaatagacggattatctgttggagttttggctggaaaaactaaatctcctgtaatgctagtaggaaactcactagattataatcaaaaagaactatttaaaactatgagatttaaatctgtaacacaaattggtggaaatggaaatgaaaactcatttaag

SEQ ID NO: 294 - protein, 293 aa, Clostridium difficile
NASALTGTDRYETSIKISQAGWENAENAVLINDSAIADALAATPFAYKKNAPILLTGSSQINEKTLAELKRLKVKNVYVVGGEASINEKSLDTIKSNNISVSRISGSDRYQTSMNIAKELNNISNISKISVVNGEKGLADAVSIGAVSAQNDMPIILTNENSNITEINNLFKNKKIDKSYVIGGEYTVSKNIESKLQNPQRISGSTRNETNAKVIKEFYKDSKIDNLYVAKNGMNKQDDLIDGLSVGVLAGKTKSPVMLVGNSLDYNQKELFKTMRFKSVTQIGGNGNENSFK

SEQ ID NO: 295 - DNA, 1440 bp, Clostridium difficile
atgagaacaattagaagagttttagcattaggtttaacattagctatatttctaataaatgtacctaatgtagatgcattaacatcagatacaattaaaggtaacaatatatatgagacggctggattaatagcagataaaaagagttatgatacagcaattatggtaaatatggataattctatagcagatggtctttcagcaagtggtcttgcaggtgctgttgatgctccaattttgcttgcacaaaaaaataagataccaaatgaaacaaaacaaagattaaaaaatgttaaaaagatatacataataggtaaagaattatcaataagtaagtcagtagaaactgaactaaaaaacacaggggcacaggtaactagattaggtggagatgacagaataaagactagttatagtgttgctaaagaggtaaatggtatcaaaaaagttgatgaagtgatattaactaatgcatataaaggagaagcagatacaataagtgctgcacctgtatcagtaagagatatagctcctatagtacttacagatggaaagagtgtgcctttttcaacaagcaatgtaaaaacatatgcagtaggtgggagtatatcaatgagcactagtttagttaataaaactaatgctaaaagacttggtggttcagatagatatgatacaaataagaaagttataaaagagttttatccagatgcatcagaattttatttgagtgatggatatgatttagtaaatgcacttacaggttctacaattgctaaggaaaatccaattgtattggtgtcagaaagtagtgataagtctatattagcaggagcagataagattactagattaggttcaataagtgacagtgtgtataataagtgtgtttctgctgcacaaaataatggcgattcgtctacaaaaggtgagtcacctatgaaaaatgagacaagcatattaggtcagccaacagctagtttagaagcgtgcttaaaatgggcaaaatctaaaaaagctaatgatttatttatagagttaataccaatattatatgatactgctgttcaggaaggtgttaatcctgttttggcagtagctcaatctgcaaaagaaactggtttttgtaattttggtggagtattagatgcatcatttaagaatccttgtggacttaaaacttctgtaggtggttctgatactgataagaatgcccattcaagatttgatacttgggaagaaggaatattagctcaaattcaacatttatgcttatatgcaggacaagatggttacccactttcaaatccagtagaccctagacatgaaaaatctttatttggtaaggctaaaacagttgaaagtttatctaataattgggctggaggtcaatatggacaagatttagtaagaatgatgggagaaattgaggcaacaaaa

SEQ ID NO: 296 - protein, 480 aa, Clostridium difficile
MRTIRRVLALGLTLAIFLINVPNVDALTSDTIKGNNIYETAGLIADKKSYDTAIMVNMDNSIADGLSASGLAGAVDAPILLAQKNKIPNETKQRLKNVKKIYIIGKELSISKSVETELKNTGAQVTRLGGDDRIKTSYSVAKEVNGIKKVDEVILTNAYKGEADTISAAPVSVRDIAPIVLTDGKSVPFSTSNVKTYAVGGSISMSTSLVNKTNAKRLGGSDRYDTNKKVIKEFYPDASEFYLSDGYDLVNALTGSTIAKENPIVLVSESSDKSILAGADKITRLGSISDSVYNKCVSAAQNNGDSSTKGESPMKNETSILGQPTASLEACLKWAKSKKANDLFIELIPILYDTAVQEGVNPVLAVAQSAKETGFCNFGGVLDASFKNPCGLKTSVGGSDTDKNAHSRFDTWEEGILAQIQHLCLYAGQDGYPLSNPVDPRHEKSLFGKAKTVESLSNNWAGGQYGQDLVRMMGEIEATK

SEQ ID NO: 297 - DNA, 1575 bp, Clostridium difficile
atgaaagcaccaaaaactattttaacaatactgacaatagcgcttactttaagtagcatttctataataccatcatatgcacttacagaggaaaaattaataggtaatggtagatatgaaactgctgtaaagataagtcaaaaggcatacagttctagtcctaatgtagtgctagttaatgacaattcattagctgatgcactttcagctacaccatttgcaaaggctaaaggagcaccaatacttttgacagaaagtgataagctagatgataggactgaaaaagagataaaacgtctaggagctaaagatatttatttgataggaggtactgctgtacttaataaagatatagagaacaagttaaaaggtaatggacttaatgtagaaagaattaatggtaagaatagatatgaaacttcactgattttggctaataagcttaaggatataaaagatattaaggaagttgctgtagtaaatggtgaaaaaggattaagtgatgctgttagtgttggagcaccagcagctcaaaataagatgcctataattttgtctaaccctaaggacggagtagaagcatttgataaatttataagggatgagaaagttataaaagcatatgtaattggaggtacaaattctgtttcaagagctgtagaaaagagtcttcctaatgcagaaagagtgagtgggaaagatagaaatgagactaatgctaaagttatagaaaagttttacactgatacaaatttaagtaatttatatgtaactaaggatggtagtaaaaatgagaatcaactaatagactcgttagctgttggagtattggctgcaaaaaatgagtctcctattgttttggttggcaataaattaaacacaaaacaaagagatatacttagtactaaaaaattaaatactataacacaggtaggtggaaatggaaatgaagaagcttttgatgaaattaaaagtctacaagaaaaaactgtgtttgaagcgaaaactgttgaagaattaactgatatgataaatatagcaagtcctaatgatattataaactttaaaccaaaggagaatactgtaaatgaagcttttagaatggtaacaaataaaccaataactgtgaatataaagggtgattgttcaaagactcttacagtagatatgcctaatggtgaagtgaataactatgctactttggtaaatgttatagttagaaatattggagaaggtggatttaataatcatgatacaatcactatattgtcagttcgtgacaaaaatggtagagttatagaaaatactagaaattcagatatagatacgttgatgatattagcttctgctaatgatacaaaattgattaatgatggatatataggaaaacttatagataattcatctaatagtgatataactaataatggtactatagataaaaaagttaatcaggttgaagatttagaggctaaagtagattcaattgaaaaagctatagattctataagtcaaaaagtcaataaaatacaagatatactagataagcttggatttctaaagaaatttcttagc

SEQ ID NO: 298 - protein, 525 aa, Clostridium difficile
MKAPKTILTILTIALTLSSISIIPSYALTEEKLIGNGRYETAVKISQKAYSSSPNVVLVNDNSLADALSATPFAKAKGAPILLTESDKLDDRTEKEIKRLGAKDIYLIGGTAVLNKDIENKLKGNGLNVERINGKNRYETSLILANKLKDIKDIKEVAVVNGEKGLSDAVSVGAPAAQNKMPIILSNPKDGVEAFDKFIRDEKVIKAYVIGGTNSVSRAVEKSLPNAERVSGKDRNETNAKVIEKFYTDTNLSNLYVTKDGSKNENQLIDSLAVGVLAAKNESPIVLVGNKLNTKQRDILSTKKLNTITQVGGNGNEEAFDEIKSLQEKTVFEAKTVEELTDMINIASPNDIINFKPKENTVNEAFRMVTNKPITVNIKGDCSKTLTVDMPNGEVNNYATLVNVIVRNIGEGGFNNHDTITILSVRDKNGRVIENTRNSDIDTLMILASANDTKLINDGYIGKLIDNSSNSDITNNGTIDKKVNQVEDLEAKVDSIEKAIDSISQKVNKIQDILDKLGFLKKFLS

SEQ ID NO: 299 - DNA, 660 bp, Clostridium difficile
atgagaccaagtaaaaaattattaatagctataatatcaatattcttaataagttcagttccagtaagtgcacatgcagatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaa

SEQ ID NO: 300 - protein, 220 aa, Clostridium difficile
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIDHIVLNDISKSAQFKQIFAKEGRSLGNVNYLGVYPEEFFAESFAYYYLNQDTNSKLKSACPQTYSFLQNLAK

SEQ ID NO: 301 - DNA, 2385 bp, Clostridium difficile
gtgaaaaaatttacttcaaaaaaagtaacaaggtttgttgcgctgtttttaatatctattttagtaatgtcaacaattcctgtatcagctgacaatagcaatacattgaatcagataaaaaaagcagaatacagtgagacgtataaacaatatctaaatgatgctaaaaatggacgtacagaaaaatataatgggattataccaaatccatatcagttggaaggtactcaaatccaaagtaaaggaagaacagctccaacatcttatgaccctagaaaattaggtcttatgacatcaataaaaaatcaagaggatttaggaatctgttgggattttgctgcaatggcaaccttagaaagtttcttaaagttaaataattatggagactatgatttatcagaagaacacttaagatggtgggcttcagatggtgaatatggatggtctgtagatgatatgaatggtgctttaaattatgaagctatgggatatttaacatcttggtcaggtcctaaattagaaaaagatatcccatacaatggtagagtatctaaagcacaaggagcaaaaaaaccaactaatatgaatacagcacctactgtttttaatgtgacagatgctgtgtgtgtaagtaatgacataaattctacaaaaaatgctatattacagtatggagcagtaacatctggttattatgaagatattaaatatcaaagtgatgaccaaaattcatattattgtccaacaaaaagttttaatacaaatcatgctatttcaattgtaggttgggatgataactattctaaagataattttaatgcaaatattagaccatcaaaaaatggtgcttggttaataaaaaatagctggggagattataattctgagggtggatatttctggatatcttatgaagacaagacacttatgtctgatatagataatttttcaatcaaaggtggtaaaaaaccaaatgatgatgagaagatgtatcaacatgactatgcaagtattgtacctttaatttcaaaaaagataacagctgcaaatgtatttgatttcaatagaggcgatgaaactctaaaatctgtaatgttcttaactgaaagtataggagctaagtatgaagtatattatgctccagtagtaaatggtatacctcaagaaaacaatatgaaaaaattaaaagaaggtactgcccaatattcaggatacataacagttccaattgattcttttgatataccagaaggaaagggtgcaattgtagtcagcatagaggggaaaaatggagagtcaactataggttctgagtcaaatgtaccaggatatgatacatttaaagcaaaagctaatttaggtgaaagttatatcatagataatactggaaaattctttgatataaatagagatagtaacttctatccatgtaattttactataaaagctgttacagaaaagtcttctggtgagagtatcccaaatgagtctttaattggtagtgatagatatgaaactgctatcaaagttagtcaaaatggtttcaattcttcagaaaatgtagttttagtaaatggcagttcaatagtagatgcattggcagcaactccttttacatctgctataaattcaccaatattattgacacaaaaagaagctttaaattcaaaaactaaagctgagatacagagattaggtgctaagaaagtatacctaataggtggagaaaattctataagtaaagaaattgaacaacaattaaaaagcttaaatatatcgatagagagaatatcaggaagtgatagatacaagacaagtttattattagctcaaaagttaaatggtataaaaaatgtatctcaaatagcagttgtaaatggagtgaaaggattagctgatgcaattagtgtaggcgctgcagcagcagaaaataacataccaatcatacttgcaaatgaaaagagcgaattgcaaggagctgatgaatttctaaattcattaaatatagagaaatcttatattattggaggaacagcatccctatcaaacaatctagaaagtaagttaaaaaatccaactagattatctggtagtagtagagacgaaactaattcaaagataatagataatttttataaaaaagatactttaaaaaatgcatttgtagttaaaaatggaatcaagaatcaaaatgatttaatagatggattggcagttggtcctttaggagcaaaaactgggtcaccagtaattttagttggtgataaattagctgatagccaaaaagaagttcttaaaaataagactttagaaaaagtaactcaagttggtggaggagcaaataaaaatgcatttaaagagttagtaaaattaaaaagtgctaaa

SEQ ID NO: 302 - protein, 795 aa, Clostridium difficile
MKKFTSKKVTRFVALFLISILVMSTIPVSADNSNTLNQIKKAEYSETYKQYLNDAKNGRTEKYNGIIPNPYQLEGTQIQSKGRTAPTSYDPRKLGLMTSIKNQEDLGICWDFAAMATLESFLKLNNYGDYDLSEEHLRWWASDGEYGWSVDDMNGALNYEAMGYLTSWSGPKLEKDIPYNGRVSKAQGAKKPTNMNTAPTVFNVTDAVCVSNDINSTKNAILQYGAVTSGYYEDIKYQSDDQNSYYCPTKSFNTNHAISIVGWDDNYSKDNFNANIRPSKNGAWLIKNSWGDYNSEGGYFWISYEDKTLMSDIDNFSIKGGKKPNDDEKMYQHDYASIVPLISKKITAANVFDFNRGDETLKSVMFLTESIGAKYEVYYAPVVNGIPQENNMKKLKEGTAQYSGYITVPIDSFDIPEGKGAIVVSIEGKNGESTIGSESNVPGYDTFKAKANLGESYIIDNTGKFFDINRDSNFYPCNFTIKAVTEKSSGESIPNESLIGSDRYETAIKVSQNGFNSSENVVLVNGSSIVDALAATPFTSAINSPILLTQKEALNSKTKAEIQRLGAKKVYLIGGENSISKEIEQQLKSLNISIERISGSDRYKTSLLLAQKLNGIKNVSQIAVVNGVKGLADAISVGAAAAENNIPIILANEKSELQGADEFLNSLNIEKSYIIGGTASLSNNLESKLKNPTRLSGSSRDETNSKIIDNFYKKDTLKNAFVVKNGIKNQNDLIDGLAVGPLGAKTGSPVILVGDKLADSQKEVLKNKTLEKVTQVGGGANKNAFKELVKLKSAK

SEQ ID NO: 303 - DNA, 1884 bp, Clostridium difficile; identical to SEQ ID NO: 192

SEQ ID NO: 304 - protein, 628 aa, Clostridium difficile; identical to SEQ ID NO: 193

SEQ ID NO: 305 - DNA, 1569 bp, Clostridium difficile
atgaagaataaaaaggctgcgggagtaattcttggagcagtgcttttgatagtgggagtagtaatctctttatttgcaggtagtaagattgtatttgcacaaggagggttgtttacgacacttgtaaatccgatagaagccgttgctcaaataaaagtagaagtagaagttaatgttaagtatatttttgaagatgaaaaagtctttaaggaggaaaagattaaggctgaaaaggggcggcttcttgacagtggagatcttccaataattcctgatgatatgaaatttatagatgactttctattttatgaagtaaagggagacgggaaagatgaaattatccgtaaagttacaaagattgatgttaaggataaggaaacgcaaacagaaaatgaaagctcaaaatctgagcaaagctctcaatcaaatgcttcaaagatagaaaataagggaactcaaacagagcttagcaaagatgatatttctaaaatggaaaaggagtctaaggaacttaaagaaaaacttgataagctaaatcaggagattaaggacaaggataaactaagcgagaagcaaaaggataaaatcaaagaccttgaggagaaaatagataaactgaaggaaaaacttgaaaagggcaaagatgataaggacttatcagcagatatgaaaaaggagatagacaagctaactgataagattaaggaacttgagaaaaaggctaatgaggtcggtagagctcctgttatgcataatcctactgtaacaccaattagccctatttccggaattaaacaaggaacaggaaatgtatcaccacaaacatctataaatagcagtggtaaaggttctgccacgcaggaaagtaaaggggcaaatacaaaagatacaaacagcaatgaatcaaaggagaaagaaaagcaagtttgttatccaaataagctgacaccaaaacagcctgctaataatggtagtcatgattcttctctggatggttcaagtaagaatataaataccaacaaaggagttgcttcagaaccttcaaaggcacgaggaacagttactgaaaataaggataatgcaaacaaaaattatcctattcaccataatgacagtaaagataataaagaaacggataaatattctgctgatgcaagacagtttgttacctttacaactaaaaatggtaagacctttcatttaatcattaaccatgatgaggatagcgagaaggttatgctcctaactgaagtatctgaagatgatctcttaaatatggtagaaaagaaagcaccggagaaagagattgttaaagaagaatcacaaaaagaagagcctaaacaagtgaaaaaagaagaaagcagtaatacaggaacctacttaattctcattcttgtagtagcgggagccttaggtgcaggatattattttaaggttattaagaaaaaagaagataaggagcttgaaggctttgaggaggaagatgatgatttcttttcagaggcagaagaaagcgaaaatgaagtaaacgaagcagtaacagaagataaagaagatgatgagatagag

SEQ ID NO: 306 - protein, 523 aa, Clostridium difficile
MKNKKAAGVILGAVLLIVGVVISLFAGSKIVFAQGGLFTTLVNPIEAVAQIKVEVEVNVKYIFEDEKVFKEEKIKAEKGRLLDSGDLPIIPDDMKFIDDFLFYEVKGDGKDEIIRKVTKIDVKDKETQTENESSKSEQSSQSNASKIENKGTQTELSKDDISKMEKESKELKEKLDKLNQEIKDKDKLSEKQKDKIKDLEEKIDKLKEKLEKGKDDKDLSADMKKEIDKLTDKIKELEKKANEVGRAPVMHNPTVTPISPISGIKQGTGNVSPQTSINSSGKGSATQESKGANTKDTNSNESKEKEKQVCYPNKLTPKQPANNGSHDSSLDGSSKNINTNKGVASEPSKARGTVTENKDNANKNYPIHHNDSKDNKETDKYSADARQFVTFTTKNGKTFHLIINHDEDSEKVMLLTEVSEDDLLNMVEKKAPEKEIVKEESQKEEPKQVKKEESSNTGTYLILILVVAGALGAGYYFKVIKKKEDKELEGFEEEDDDFFSEAEESENEVNEAVTEDKEDDEIE

SEQ ID NO: 307 - DNA, 2274 bp, Clostridium difficile
atgaataagaagaatatagcaatagctatgtcaggattaacagtattagcttctgcagcacctgtgtttgcagcagaagatatgtcgaaagttgagactggtgatcaaggatatacagtagtacagagcaagtataagaaagcagttgaacaattacaaaaagggttattagatggaagtataacagagattaaaattttctttgagggaactttagcatctactataaaagtaggagctgagcttagtgcagaagatgcaagtaaattattgtttacacaagtagataataaattagacaatttaggtgatggggattatgtagatttcttaataagctctccagcagagggagataaagtaactacaagtaaacttgttgcattaaaaaatttaacaggtggaactagtgcaataaaagtagctacaagtagtattattggtgaagtcgaaaatgctggtactccgggagcaaaaaatacagctccaagtagtgctgcagttatgtctatgtcagatgtatttgatacagcttttacagattcaactgaaactgctgtgaaacttactataaaagatgctatgaaaactaaaaagtttggtttagttgatggaactacttattcaacaggtcttcaatttgcagatggaaaaacagaaaaaattgttaaattaggagatagtgatactataaatttagccaaagaattaataataacacctgcaagtgcaaatgatcaagctgcgactattgagtttgctaaaccaacaacacaatctggaagcccagtaataactaaacttagaatattgaatgcaaaagaagagacaatagatattgatgctagttctagtaaaacagcacaagatttagctaaaaaatatgtatttaataaaacagatttaaatactctttacagagtattaaatggggatgaagcagatactaatagattagtagaagaagttagtggaaaatatcaagtggttctttatccagaaggaaaaagagttacaactaagagtgctgcaaaggcttcaattgctgatgaaaattcaccagttaaattaactcttaagtcagataagaagaaagacttaaaagattatgtggatgatttaagaacatataataatggatattcaaatgctatagaagtagcaggagaagatagaatagaaactgcaatagcattaagtcaaaaatattataactctgatgatgaaaatgctatatttagagattcagttgataatgtagtattggttggaggaaatgcaatagttgatggacttgtagcttctcctttagcttctgaaaagaaagctcctttattattaacttcaaaagataaattagattcaagcgtaaaagctgaaataaagagagttatgaatataaagagtacaacaggtataaatacttcaaagaaagtttatttagctggtggagttaattctatatctaaagaagtagaaaatgaattaaaagatatgggacttaaagttacaagattagcaggagatgatagatatgaaacttctctaaaaatagctgatgaagtaggtcttgataatgataaagcatttgtagttggaggaacaggattagcagatgccatgagtatagctccagttgcatctcaattaagaaatgctaatggtaaaatggatttagctgatggtgatgctacaccaatagtagttgtagatggaaaagctaaaactataaatgatgatgtaaaagatttcttagatgattcacaagttgatataataggtggagaaaacagtgtatctaaagatgttgaaaatgcaatagatgatgctacaggtaaatctccagatagatatagtggagatgatagacaagcaactaatgcaaaagttataaaagaatcttcttattatcaagataacttaaataatgataaaaaagtagttaatttctttgtagctaaagatggttctactaaagaagatcaattagttgatgctttagcagcagctccagttgcagcaaactttggtgtaactcttaattctgatggtaagccagtagataaagatggtaaagtattaactggttctgataatgataaaaataaattagtatctccagcacctatagtattagctactgattctttatcttcagatcaaagtgtatctataagtaaagttcttgataaagataatggagaaaacttagttcaagttggtaaaggtatagctacttcagttataaataaattaaaagatttattaagtatg

SEQ ID NO: 308 - protein, 758 aa, Clostridium difficile
MNKKNIAIAMSGLTVLASAAPVFAAEDMSKVETGDQGYTVVQSKYKKAVEQLQKGLLDGSITEIKIFFEGTLASTIKVGAELSAEDASKLLFTQVDNKLDNLGDGDYVDFLISSPAEGDKVTTSKLVALKNLTGGTSAIKVATSSIIGEVENAGTPGAKNTAPSSAAVMSMSDVFDTAFTDSTETAVKLTIKDAMKTKKFGLVDGTTYSTGLQFADGKTEKIVKLGDSDTINLAKELIITPASANDQAATIEFAKPTTQSGSPVITKLRILNAKEETIDIDASSSKTAQDLAKKYVFNKTDLNTLYRVLNGDEADTNRLVEEVSGKYQVVLYPEGKRVTTKSAAKASIADENSPVKLTLKSDKKKDLKDYVDDLRTYNNGYSNAIEVAGEDRIETAIALSQKYYNSDDENAIFRDSVDNVVLVGGNAIVDGLVASPLASEKKAPLLLTSKDKLDSSVKAEIKRVMNIKSTTGINTSKKVYLAGGVNSISKEVENELKDMGLKVTRLAGDDRYETSLKIADEVGLDNDKAFVVGGTGLADAMSIAPVASQLRNANGKMDLADGDATPIVVVDGKAKTINDDVKDFLDDSQVDIIGGENSVSKDVENAIDDATGKSPDRYSGDDRQATNAKVIKESSYYQDNLNNDKKVVNFFVAKDGSTKEDQLVDALAAAPVAANFGVTLNSDGKPVDKDGKVLTGSDNDKNKLVSPAPIVLATDSLSSDQSVSISKVLDKDNGENLVQVGKGIATSVINKLKDLLSM

SEQ ID NO: 309 - DNA, 1272 bp, Clostridium difficile
atgcaagatggtttcttaacagtaagcataattgatgctactaacaatagacctattcaaaatgcagtagtaaacatatattcaatgtctaatggtagccaaagctcatcaactttataccaaaacctaagaagtaatgaatctggtcaagtgactggtttagtattaccagcaccagatgtagattactctctacaaccatctgatgttagaccttatagccagtatatagtggaagccatagcagatggatatgagacagttgtcatagaaggaacacagttgttagctacaattgaagcaagacaaggagttcccatgtctcctagaacaagaagtaagcgttctttctcaagacaaagtgagttgatttttgatataggagaacatactctatatggtacttatcctcctaagattccagaaagtaacttaaaaccattacctcctcctactggtttcgttgtattagataaccctgtagtgcctgaatttatagtagttcatgatggtttgccagaagattcatcagctccaaactattggattccatttaaagagtacattaaaaacatagcgtcatctgaaatatattcaacttggcctgaacagacaatttatgcaaatgtaatagctataatatcatttactttaaatagagtctttactgaatggtatagaaataaaggatataactttacaataacttcaacaacagcatacgaccataagtttataaataatagaaacttatttgaaccaattaacgtagttgtagatgctatttttaatacttttataaaaagacctcctacatcaagacagccactattagcacaatattgtgatggacaaaaatcccaatgtcctgaccaaatgactcaatggggcagtaaagacttaggtgaccaaggatatgactatgagagtatactaagatatttctatggagatgaaatagtatttgaaagagcacctatagtaagtggtgtaccagtgtcattccctggtactacactacaagttggttcttctgggcagtatgttagaaccatacaaaatcagttaaatgctatatctaattcttatccagctgtaccaaaagttatagaagatggtatctatggaacagatacagaaaacgctgttaagatattccaaggaatctttggtttacctcaaagcggagtagtagattttaaaacatggtatgaaatatccagagtttatgtagctacaactagaatagcttctttaaatcctttaatttaa

SEQ ID NO: 310 - protein, 423 aa, Clostridium difficile
MQDGFLTVSIIDATNNRPIQNAVVNIYSMSNGSQSSSTLYQNLRSNESGQVTGLVLPAPDVDYSLQPSDVRPYSQYIVEAIADGYETVVIEGTQLLATIEARQGVPMSPRTRSKRSFSRQSELIFDIGEHTLYGTYPPKIPESNLKPLPPPTGFVVLDNPVVPEFIVVHDGLPEDSSAPNYWIPFKEYIKNIASSEIYSTWPEQTIYANVIAIISFTLNRVFTEWYRNKGYNFTITSTTAYDHKFINNRNLFEPINVVVDAIFNTFIKRPPTSRQPLLAQYCDGQKSQCPDQMTQWGSKDLGDQGYDYESILRYFYGDEIVFERAPIVSGVPVSFPGTTLQVGSSGQYVRTIQNQLNAISNSYPAVPKVIEDGIYGTDTENAVKIFQGIFGLPQSGVVDFKTWYEISRVYVATTRIASLNPLI

SEQ ID NO: 311 - DNA, 948 bp, Clostridium difficile
gatgaagtaaatgattcatctcaaaataaggatgataaaacaaatactgaattaaatttaggtgaatataaagaagtaaaatataaagttgcaaaaataaaagatggagtagctataaagataagagaagaaggtcaagttcaaaacatagcttattctggagatgaatttacggttttaggaactcaaggagaatgggttaaggttaaagttgaagatggcgaaggttggttagctactagatatgtagatatatctgaaggtgtaggatatactaacgctgataaagtaaacttaagaaaagataagagtgaaagttcagaagtaattgaagagctggaaaaaggaagttctttattggttttggaagataatggagattggttaaaagttaaagatggggaaacagaaggatatgtaaaatcatcttatatatctgataaagctcctgtaatagaagagccacaagtaaacccaagtattgaccaaaatgtagattctacaaataataatcaacaaaacaatgcaaatactaatcaacaaaataataattcaaatgtgccaacagctaactctaatgcagttcaagctgtacttaacttggcatattctaagcaaggttgtccatatgtttggggagcagaaggaccaaacacttttgactgttctggatttacacaatatgtgtatagaaatgcagtaggaaagaatataccaagaacatctaaagcacaatctaaatatggacaaactgtaagtaaagcaaatttacaaccaggagacttagtattcttcacaactaatggttctggttctgttagtcatgttggaatatatgtaggtgggggtaatatgatacattcaccatcaacaggaaaaacagttagtgtaactagtataaattcatcatactatacagcaagatttgttacagcaaaaagaatatta

SEQ ID NO: 312 - protein, 316 aa, Clostridium difficile
DEVNDSSQNKDDKTNTELNLGEYKEVKYKVAKIKDGVAIKIREEGQVQNIAYSGDEFTVLGTQGEWVKVKVEDGEGWLATRYVDISEGVGYTNADKVNLRKDKSESSEVIEELEKGSSLLVLEDNGDWLKVKDGETEGYVKSSYISDKAPVIEEPQVNPSIDQNVDSTNNNQQNNANTNQQNNNSNVPTANSNAVQAVLNLAYSKQGCPYVWGAEGPNTFDCSGFTQYVYRNAVGKNIPRTSKAQSKYGQTVSKANLQPGDLVFFTTNGSGSVSHVGIYVGGGNMIHSPSTGKTVSVTSINSSYYTARFVTAKRIL

SEQ ID NO: 313 - DNA, 1509 bp, Clostridium difficile
acaatatcaaattttagcttatcttcatatgcatcagaaattacttccagcacagataaggtattaatcatatatgattctaagaaagaaacagcttataatagagatattttaaatattatgaggactctattgggaagatttagttcagatatagagctattaaaattgagtaactatgatggtgagataaataaaaattattacagtcatatatttattttaggaatcaatgaaaactcatataataatgataaaaacactaaaaacttgattagttccttaaattcatataaaggaactatatgttggttaggatatggtatagaaaatcttttggaacataaaaaatacaatttagactatgtaggaaaaacaaacaatatagttagtgtaaattatagaggtaaatcatataacttggatgaacattatgtttttaacattgtagaatcaaaagatacaagtaataaagtaataggaagtattaatgataccttaaataagtatccatatataataaatgataaaaatcttttttatgtatcaaaattagatttagatggagttttattttatatattttgcgattcacttaatgatatttttaatattaagacgtttgataaaggacgtatatttgtaagaatagaagatgtacatgcttttagagaaccaaaaaatcttgtagagatagcggattatttaagtagtaagaatataccatttacgattgcattaataccagcatatgtaaatcctaaaaatcataaggtaataactttatcagaaagccctgaaattgtcaaagcaataaaatatatgcaagataaaggtggaactgtgatattgcatggatatactcatcaatacaagaaagaagaagtttctggagaagggtatgaattttgggatggtaaaaaagatgaacccttaaaagaaaatatgaagatatttgtcaaagatagagttttgaatggtcttagagtatgtatagagaatggaatttatcctcttgcatttgaagcgccacattatgcaatggaatcagagggatataaagaattaaaaaaatatttttctacttatatggggcaacatcaaaataatgataaaaaatttagcacaaatacatatccttatattattagggatacagaagagtttaatatatttatacccgaaaatttaggatatatagacccagaagataagtttacttttcaaaatataaaagaaaatttagataaattatccattgtaagaggttttagtggagggttcttctttcattcatatttaaacatagagtatctaaaaaacacaatagaatatttagaaaaacagaatatagaatttatgaatttaagagattttaataattgggtaaaagttgatgaaatacaaataagaaatagtggagatgaaattatagtcaactatgataaggacttagatgaaataactaaaagtgatactagatttaaatccatatccaatattagtaaa

SEQ ID NO: 314 - protein, 503 aa, Clostridium difficile
TISNFSLSSYASEITSSTDKVLIIYDSKKETAYNRDILNIMRTLLGRFSSDIELLKLSNYDGEINKNYYSHIFILGINENSYNNDKNTKNLISSLNSYKGTICWLGYGIENLLEHKKYNLDYVGKTNNIVSVNYRGKSYNLDEHYVFNIVESKDTSNKVIGSINDTLNKYPYIINDKNLFYVSKLDLDGVLFYIFCDSLNDIFNIKTFDKGRIFVRIEDVHAFREPKNLVEIADYLSSKNIPFTIALIPAYVNPKNHKVITLSESPEIVKAIKYMQDKGGTVILHGYTHQYKKEEVSGEGYEFWDGKKDEPLKENMKIFVKDRVLNGLRVCIENGIYPLAFEAPHYAMESEGYKELKKYFSTYMGQHQNNDKKFSTNTYPYIIRDTEEFNIFIPENLGYIDPEDKFTFQNIKENLDKLSIVRGFSGGFFFHSYLNIEYLKNTIEYLEKQNIEFMNLRDFNNWVKVDEIQIRNSGDEIIVNYDKDLDEITKSDTRFKSISNISK

SEQ ID NO: 315 - DNA, 975 bp, Clostridium difficile
gacactattagtaaaaatcaaaatgcacaggtagatatgaacaattatcttcaaggtagaaaatctccaaaggaggaaaaacttattggtgaagatagatttgatacagcgataaaaatatctcaaagtggttggaataatggttcagaaagggtgtttctagttaactcaaattcattgccagatgcattggcttcaactcctttggcaagtaaattggatgcaccaatactgcttacaaataaaaatagtataccatataatgtaacagaggaaataaaaaggcttaatccagcagaagttattttaattggaagtgaaggagctatttcatcaagtgtaaaagaatctcttgaagatatggaagtattagtcagtagaatcggtggagcagatagagaagaaacatctttacttcttactagacagctagatgatactggtgatttaggtgtctcaaaagtggcagtggttaatgggtataatggactggcagatgcaacttcaatatcaagcccagctgcaagtgataatacagctataatatatacaggtaaggatagcataagaagtgaggcaaagaattttattacacaaaactcaactaagacatacatagtaggtggggagtacagtataagtaaaaaacttgaaggacagttagtaaactcagaaagactagcagggacagatagaaaagatactaatgcgaaagttttagaaaagttttatggaaaatcaagtaaggttaataatatgtattttgcaaaagatggaagtggtagagaagctgatttagttgatgggcttgctgctggagtattagcatcaaaaacaaagtcacctgtagtacttgcaagtggaagtttaagtagtgcacagaaaagttttataaaaaaagtaaaggctgataaatttgtacaagttggtggaggtaaaaatagtaaaccatatgcagaagcattagccttacag

SEQ ID NO: 316 - protein, 325 aa, Clostridium difficile
DTISKNQNAQVDMNNYLQGRKSPKEEKLIGEDRFDTAIKISQSGWNNGSERVFLVNSNSLPDALASTPLASKLDAPILLTNKNSIPYNVTEEIKRLNPAEVILIGSEGAISSSVKESLEDMEVLVSRIGGADREETSLLLTRQLDDTGDLGVSKVAVVNGYNGLADATSISSPAASDNTAIIYTGKDSIRSEAKNFITQNSTKTYIVGGEYSISKKLEGQLVNSERLAGTDRKDTNAKVLEKFYGKSSKVNNMYFAKDGSGREADLVDGLAAGVLASKTKSPVVLASGSLSSAQKSFIKKVKADKFVQVGGGKNSKPYAEALALQ

SEQ ID NO: 317 - DNA, 1383 bp, Clostridium difficile
aatgtacctaatgtagatgcattaacatcagatacaattaaaggtaacaatatatatgagacggctggattaatagcagataaaaagagttatgatacagcaattatggtaaatatggataattctatagcagatggtctttcagcaagtggtcttgcaggtgctgttgatgctccaattttgcttgcacaaaaaaataagataccaaatgaaacaaaacaaagattaaaaaatgttaaaaagatatacataataggtaaagaattatcaataagtaagtcagtagaaactgaactaaaaaacacaggggcacaggtaactagattaggtggagatgacagaataaagactagttatagtgttgctaaagaggtaaatggtatcaaaaaagttgatgaagtgatattaactaatgcatataaaggagaagcagatacaataagtgctgcacctgtatcagtaagagatatagctcctatagtacttacagatggaaagagtgtgcctttttcaacaagcaatgtaaaaacatatgcagtaggtgggagtatatcaatgagcactagtttagttaataaaactaatgctaaaagacttggtggttcagatagatatgatacaaataagaaagttataaaagagttttatccagatgcatcagaattttatttgagtgatggatatgatttagtaaatgcacttacaggttctacaattgctaaggaaaatccaattgtattggtgtcagaaagtagtgataagtctatattagcaggagcagataagattactagattaggttcaataagtgacagtgtgtataataagtgtgtttctgctgcacaaaataatggcgattcgtctacaaaaggtgagtcacctatgaaaaatgagacaagcatattaggtcagccaacagctagtttagaagcgtgcttaaaatgggcaaaatctaaaaaagctaatgatttatttatagagttaataccaatattatatgatactgctgttcaggaaggtgttaatcctgttttggcagtagctcaatctgcaaaagaaactggtttttgtaattttggtggagtattagatgcatcatttaagaatccttgtggacttaaaacttctgtaggtggttctgatactgataagaatgcccattcaagatttgatacttgggaagaaggaatattagctcaaattcaacatttatgcttatatgcaggacaagatggttacccactttcaaatccagtagaccctagacatgaaaaatctttatttggtaaggctaaaacagttgaaagtttatctaataattgggctggaggtcaatatggacaagatttagtaagaatgatgggagaaattgaggcaacaaaa

SEQ ID NO: 318 - protein, 461 aa, Clostridium difficile
NVPNVDALTSDTIKGNNIYETAGLIADKKSYDTAIMVNMDNSIADGLSASGLAGAVDAPILLAQKNKIPNETKQRLKNVKKIYIIGKELSISKSVETELKNTGAQVTRLGGDDRIKTSYSVAKEVNGIKKVDEVILTNAYKGEADTISAAPVSVRDIAPIVLTDGKSVPFSTSNVKTYAVGGSISMSTSLVNKTNAKRLGGSDRYDTNKKVIKEFYPDASEFYLSDGYDLVNALTGSTIAKENPIVLVSESSDKSILAGADKITRLGSISDSVYNKCVSAAQNNGDSSTKGESPMKNETSILGQPTASLEACLKWAKSKKANDLFIELIPILYDTAVQEGVNPVLAVAQSAKETGFCNFGGVLDASFKNPCGLKTSVGGSDTDKNAHSRFDTWEEGILAQIQHLCLYAGQDGYPLSNPVDPRHEKSLFGKAKTVESLSNNWAGGQYGQDLVRMMGEIEATK

SEQ ID NO: 319 - DNA, 1509 bp, Clostridium difficile
ataccatcatatgcacttacagaggaaaaattaataggtaatggtagatatgaaactgctgtaaagataagtcaaaaggcatacagttctagtcctaatgtagtgctagttaatgacaattcattagctgatgcactttcagctacaccatttgcaaaggctaaaggagcaccaatacttttgacagaaagtgataagctagatgataggactgaaaaagagataaaacgtctaggagctaaagatatttatttgataggaggtactgctgtacttaataaagatatagagaacaagttaaaaggtaatggacttaatgtagaaagaattaatggtaagaatagatatgaaacttcactgattttggctaataagcttaaggatataaaagatattaaggaagttgctgtagtaaatggtgaaaaaggattaagtgatgctgttagtgttggagcaccagcagctcaaaataagatgcctataattttgtctaaccctaaggacggagtagaagcatttgataaatttataagggatgagaaagttataaaagcatatgtaattggaggtacaaattctgtttcaagagctgtagaaaagagtcttcctaatgcagaaagagtgagtgggaaagatagaaatgagactaatgctaaagttatagaaaagttttacactgatacaaatttaagtaatttatatgtaactaaggatggtagtaaaaatgagaatcaactaatagactcgttagctgttggagtattggctgcaaaaaatgagtctcctattgttttggttggcaataaattaaacacaaaacaaagagatatacttagtactaaaaaattaaatactataacacaggtaggtggaaatggaaatgaagaagcttttgatgaaattaaaagtctacaagaaaaaactgtgtttgaagcgaaaactgttgaagaattaactgatatgataaatatagcaagtcctaatgatattataaactttaaaccaaaggagaatactgtaaatgaagcttttagaatggtaacaaataaaccaataactgtgaatataaagggtgattgttcaaagactcttacagtagatatgcctaatggtgaagtgaataactatgctactttggtaaatgttatagttagaaatattggagaaggtggatttaataatcatgatacaatcactatattgtcagttcgtgacaaaaatggtagagttatagaaaatactagaaattcagatatagatacgttgatgatattagcttctgctaatgatacaaaattgattaatgatggatatataggaaaacttatagataattcatctaatagtgatataactaataatggtactatagataaaaaagttaatcaggttgaagatttagaggctaaagtagattcaattgaaaaagctatagattctataagtcaaaaagtcaataaaatacaagatatactagataagcttggatttctaaagaaatttcttagc

SEQ ID NO: 320 - protein, 503 aa, Clostridium difficile
IPSYALTEEKLIGNGRYETAVKISQKAYSSSPNVVLVNDNSLADALSATPFAKAKGAPILLTESDKLDDRTEKEIKRLGAKDIYLIGGTAVLNKDIENKLKGNGLNVERINGKNRYETSLILANKLKDIKDIKEVAVVNGEKGLSDAVSVGAPAAQNKMPIILSNPKDGVEAFDKFIRDEKVIKAYVIGGTNSVSRAVEKSLPNAERVSGKDRNETNAKVIEKFYTDTNLSNLYVTKDGSKNENQLIDSLAVGVLAAKNESPIVLVGNKLNTKQRDILSTKKLNTITQVGGNGNEEAFDEIKSLQEKTVFEAKTVEELTDMINIASPNDIINFKPKENTVNEAFRMVTNKPITVNIKGDCSKTLTVDMPNGEVNNYATLVNVIVRNIGEGGFNNHDTITILSVRDKNGRVIENTRNSDIDTLMILASANDTKLINDGYIGKLIDNSSNSDITNNGTIDKKVNQVEDLEAKVDSIEKAIDSISQKVNKIQDILDKLGFLKKFLS

SEQ ID NO: 321 - DNA, 582 bp, Clostridium difficile
gatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaa

SEQ ID NO: 322 - protein, 194 aa, Clostridium difficile
DSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIDHIVLNDISKSAQFKQIFAKEGRSLGNVNYLGVYPEEFFAESFAYYYLNQDTNSKLKSACPQTYSFLQNLAK

SEQ ID NO: 323 - DNA, 2295 bp, Clostridium difficile
gacaatagcaatacattgaatcagataaaaaaagcagaatacagtgagacgtataaacaatatctaaatgatgctaaaaatggacgtacagaaaaatataatgggattataccaaatccatatcagttggaaggtactcaaatccaaagtaaaggaagaacagctccaacatcttatgaccctagaaaattaggtcttatgacatcaataaaaaatcaagaggatttaggaatctgttgggattttgctgcaatggcaaccttagaaagtttcttaaagttaaataattatggagactatgatttatcagaagaacacttaagatggtgggcttcagatggtgaatatggatggtctgtagatgatatgaatggtgctttaaattatgaagctatgggatatttaacatcttggtcaggtcctaaattagaaaaagatatcccatacaatggtagagtatctaaagcacaaggagcaaaaaaaccaactaatatgaatacagcacctactgtttttaatgtgacagatgctgtgtgtgtaagtaatgacataaattctacaaaaaatgctatattacagtatggagcagtaacatctggttattatgaagatattaaatatcaaagtgatgaccaaaattcatattattgtccaacaaaaagttttaatacaaatcatgctatttcaattgtaggttgggatgataactattctaaagataattttaatgcaaatattagaccatcaaaaaatggtgcttggttaataaaaaatagctggggagattataattctgagggtggatatttctggatatcttatgaagacaagacacttatgtctgatatagataatttttcaatcaaaggtggtaaaaaaccaaatgatgatgagaagatgtatcaacatgactatgcaagtattgtacctttaatttcaaaaaagataacagctgcaaatgtatttgatttcaatagaggcgatgaaactctaaaatctgtaatgttcttaactgaaagtataggagctaagtatgaagtatattatgctccagtagtaaatggtatacctcaagaaaacaatatgaaaaaattaaaagaaggtactgcccaatattcaggatacataacagttccaattgattcttttgatataccagaaggaaagggtgcaattgtagtcagcatagaggggaaaaatggagagtcaactataggttctgagtcaaatgtaccaggatatgatacatttaaagcaaaagctaatttaggtgaaagttatatcatagataatactggaaaattctttgatataaatagagatagtaacttctatccatgtaattttactataaaagctgttacagaaaagtcttctggtgagagtatcccaaatgagtctttaattggtagtgatagatatgaaactgctatcaaagttagtcaaaatggtttcaattcttcagaaaatgtagttttagtaaatggcagttcaatagtagatgcattggcagcaactccttttacatctgctataaattcaccaatattattgacacaaaaagaagctttaaattcaaaaactaaagctgagatacagagattaggtgctaagaaagtatacctaataggtggagaaaattctataagtaaagaaattgaacaacaattaaaaagcttaaatatatcgatagagagaatatcaggaagtgatagatacaagacaagtttattattagctcaaaagttaaatggtataaaaaatgtatctcaaatagcagttgtaaatggagtgaaaggattagctgatgcaattagtgtaggcgctgcagcagcagaaaataacataccaatcatacttgcaaatgaaaagagcgaattgcaaggagctgatgaatttctaaattcattaaatatagagaaatcttatattattggaggaacagcatccctatcaaacaatctagaaagtaagttaaaaaatccaactagattatctggtagtagtagagacgaaactaattcaaagataatagataatttttataaaaaagatactttaaaaaatgcatttgtagttaaaaatggaatcaagaatcaaaatgatttaatagatggattggcagttggtcctttaggagcaaaaactgggtcaccagtaattttagttggtgataaattagctgatagccaaaaagaagttcttaaaaataagactttagaaaaagtaactcaagttggtggaggagcaaataaaaatgcatttaaagagttagtaaaattaaaaagtgctaaa

SEQ ID NO: 324 - protein, 765 aa, Clostridium difficile
DNSNTLNQIKKAEYSETYKQYLNDAKNGRTEKYNGIIPNPYQLEGTQIQSKGRTAPTSYDPRKLGLMTSIKNQEDLGICWDFAAMATLESFLKLNNYGDYDLSEEHLRWWASDGEYGWSVDDMNGALNYEAMGYLTSWSGPKLEKDIPYNGRVSKAQGAKKPTNMNTAPTVFNVTDAVCVSNDINSTKNAILQYGAVTSGYYEDIKYQSDDQNSYYCPTKSFNTNHAISIVGWDDNYSKDNFNANIRPSKNGAWLIKNSWGDYNSEGGYFWISYEDKTLMSDIDNFSIKGGKKPNDDEKMYQHDYASIVPLISKKITAANVFDFNRGDETLKSVMFLTESIGAKYEVYYAPVVNGIPQENNMKKLKEGTAQYSGYITVPIDSFDIPEGKGAIVVSIEGKNGESTIGSESNVPGYDTFKAKANLGESYIIDNTGKFFDINRDSNFYPCNFTIKAVTEKSSGESIPNESLIGSDRYETAIKVSQNGFNSSENVVLVNGSSIVDALAATPFTSAINSPILLTQKEALNSKTKAEIQRLGAKKVYLIGGENSISKEIEQQLKSLNISIERISGSDRYKTSLLLAQKLNGIKNVSQIAVVNGVKGLADAISVGAAAAENNIPIILANEKSELQGADEFLNSLNIEKSYIIGGTASLSNNLESKLKNPTRLSGSSRDETNSKIIDNFYKKDTLKNAFVVKNGIKNQNDLIDGLAVGPLGAKTGSPVILVGDKLADSQKEVLKNKTLEKVTQVGGGANKNAFKELVKLKSAK

SEQ ID NO: 325 - DNA, 1791 bp, Clostridium difficile; identical to SEQ ID NO: 194

SEQ ID NO: 326 - protein, 597 aa, Clostridium difficile; identical to SEQ ID NO: 195

SEQ ID NO: 327 - DNA, 1281 bp, Clostridium difficile
ggtagtaagattgtatttgcacaaggagggttgtttacgacacttgtaaatccgatagaagccgttgctcaaataaaagtagaagtagaagttaatgttaagtatatttttgaagatgaaaaagtctttaaggaggaaaagattaaggctgaaaaggggcggcttcttgacagtggagatcttccaataattcctgatgatatgaaatttatagatgactttctattttatgaagtaaagggagacgggaaagatgaaattatccgtaaagttacaaagattgatgttaaggataaggaaacgcaaacagaaaatgaaagctcaaaatctgagcaaagctctcaatcaaatgcttcaaagatagaaaataagggaactcaaacagagcttagcaaagatgatatttctaaaatggaaaaggagtctaaggaacttaaagaaaaacttgataagctaaatcaggagattaaggacaaggataaactaagcgagaagcaaaaggataaaatcaaagaccttgaggagaaaatagataaactgaaggaaaaacttgaaaagggcaaagatgataaggacttatcagcagatatgaaaaaggagatagacaagctaactgataagattaaggaacttgagaaaaaggctaatgaggtcggtagagctcctgttatgcataatcctactgtaacaccaattagccctatttccggaattaaacaaggaacaggaaatgtatcaccacaaacatctataaatagcagtggtaaaggttctgccacgcaggaaagtaaaggggcaaatacaaaagatacaaacagcaatgaatcaaaggagaaagaaaagcaagtttgttatccaaataagctgacaccaaaacagcctgctaataatggtagtcatgattcttctctggatggttcaagtaagaatataaataccaacaaaggagttgcttcagaaccttcaaaggcacgaggaacagttactgaaaataaggataatgcaaacaaaaattatcctattcaccataatgacagtaaagataataaagaaacggataaatattctgctgatgcaagacagtttgttacctttacaactaaaaatggtaagacctttcatttaatcattaaccatgatgaggatagcgagaaggttatgctcctaactgaagtatctgaagatgatctcttaaatatggtagaaaagaaagcaccggagaaagagattgttaaagaagaatcacaaaaagaagagcctaaacaagtgaaaaaagaagaa

SEQ ID NO: 328 - protein, 427 aa, Clostridium difficile
GSKIVFAQGGLFTTLVNPIEAVAQIKVEVEVNVKYIFEDEKVFKEEKIKAEKGRLLDSGDLPIIPDDMKFIDDFLFYEVKGDGKDEIIRKVTKIDVKDKETQTENESSKSEQSSQSNASKIENKGTQTELSKDDISKMEKESKELKEKLDKLNQEIKDKDKLSEKQKDKIKDLEEKIDKLKEKLEKGKDDKDLSADMKKEIDKLTDKIKELEKKANEVGRAPVMHNPTVTPISPISGIKQGTGNVSPQTSINSSGKGSATQESKGANTKDTNSNESKEKEKQVCYPNKLTPKQPANNGSHDSSLDGSSKNINTNKGVASEPSKARGTVTENKDNANKNYPIHHNDSKDNKETDKYSADARQFVTFTTKNGKTFHLIINHDEDSEKVMLLTEVSEDDLLNMVEKKAPEKEIVKEESQKEEPKQVKKEE

SEQ ID NO: 329 - DNA, 795 bp, Clostridium difficile
gcacctgtgtttgcagcagaagatatgtcgaaagttgagactggtgatcaaggatatacagtagtacagagcaagtataagaaagcagttgaacaattacaaaaagggttattagatggaagtataacagagattaaaattttctttgagggaactttagcatctactataaaagtaggagctgagcttagtgcagaagatgcaagtaaattattgtttacacaagtagataataaattagacaatttaggtgatggggattatgtagatttcttaataagctctccagcagagggagataaagtaactacaagtaaacttgttgcattaaaaaatttaacaggtggaactagtgcaataaaagtagctacaagtagtattattggtgaagtcgaaaatgctggtactccgggagcaaaaaatacagctccaagtagtgctgcagttatgtctatgtcagatgtatttgatacagcttttacagattcaactgaaactgctgtgaaacttactataaaagatgctatgaaaactaaaaagtttggtttagttgatggaactacttattcaacaggtcttcaatttgcagatggaaaaacagaaaaaattgttaaattaggagatagtgatactataaatttagccaaagaattaataataacacctgcaagtgcaaatgatcaagctgcgactattgagtttgctaaaccaacaacacaatctggaagcccagtaataactaaacttagaatattgaatgcaaaagaagagacaatagatattgatgctagttct

SEQ ID NO: 330 - protein, 265 aa, Clostridium difficile
APVFAAEDMSKVETGDQGYTVVQSKYKKAVEQLQKGLLDGSITEIKIFFEGTLASTIKVGAELSAEDASKLLFTQVDNKLDNLGDGDYVDFLISSPAEGDKVTTSKLVALKNLTGGTSAIKVATSSIIGEVENAGTPGAKNTAPSSAAVMSMSDVFDTAFTDSTETAVKLTIKDAMKTKKFGLVDGTTYSTGLQFADGKTEKIVKLGDSDTINLAKELIITPASANDQAATIEFAKPTTQSGSPVITKLRILNAKEETIDIDASS

SEQ ID NO: 331 - protein, 135 aa, Clostridium difficile
DKTNTELNLGEYKEVKYKVAKIKDGVAIKIREEGQVQNIAYSGDEFTVLGTQGEWVKVKVEDGEGWLATRYVDISEGVGYTNADKVNLRKDKSESSEVIEELEKGSSLLVLEDNGDWLKVKDGETEGYVKSSYIS

SEQ ID NO: 332 - DNA, 22 bp, Artificial Sequence
  Primer
gatgaagtaaatgattcatctc

SEQ ID NO: 333 - DNA, 26 bp, Artificial Sequence
  Primer
taatattctttttgctgtaacaaatc

SEQ ID NO: 334 - DNA, 25 bp, Artificial Sequence
  Primer
acaatatcaaattttagcttatctt

SEQ ID NO: 335 - DNA, 29 bp, Artificial Sequence
  Primer
tttactaatattggatatggatttaaatc

SEQ ID NO: 336 - DNA, 25 bp, Artificial Sequence
  Primer
gacactattagtaaaaatcaaaatg

SEQ ID NO: 337 - DNA, 20 bp, Artificial Sequence
  Primer
ctgtaaggctaatgcttctg

SEQ ID NO: 338 - DNA, 25 bp, Artificial Sequence
  Primer
gataatacaaaagataattccgaaa

SEQ ID NO: 339 - DNA, 25 bp, Artificial Sequence
  Primer
atttacttcatcttgatatgtaacc

SEQ ID NO: 340 - DNA, 19 bp, Artificial Sequence
  Primer
aatgcaagtgcacttacag

SEQ ID NO: 341 - DNA, 26 bp, Artificial Sequence
  Primer
cttaaatgagttttcatttccatttc

SEQ ID NO: 342 - DNA, 20 bp, Artificial Sequence
  Primer
aatgtacctaatgtagatgc

SEQ ID NO: 343 - DNA, 20 bp, Artificial Sequence
  Primer
ttttgttgcctcaatttctc

SEQ ID NO: 344 - DNA, 22 bp, Artificial Sequence
  Primer
ataccatcatatgcacttacag

SEQ ID NO: 345 - DNA, 24 bp, Artificial Sequence
  Primer
gctaagaaatttctttagaaatcc

SEQ ID NO: 346 - DNA, 28 bp, Artificial Sequence
  Primer
gatagtactactatacaacaaaataaag

SEQ ID NO: 347 - DNA, 23 bp, Artificial Sequence
  Primer
tttagctaaattttgcaaaaagc

SEQ ID NO: 348 - DNA, 24 bp, Artificial Sequence
  Primer
gacaatagcaatacattgaatcag

SEQ ID NO: 349 - DNA, 25 bp, Artificial Sequence
  Primer
tttagcactttttaattttactaac

SEQ ID NO: 350 - DNA, 20 bp, Artificial Sequence
  Primer
gctccagttttacaaggaac

SEQ ID NO: 351 - protein, 6 aa, Artificial Sequence
  Linker
GSGGGG

SEQ ID NO: 352 - protein, 8 aa, Artificial Sequence
  Linker
GSGSGGGG

SEQ ID NO: 353 - protein, 6 aa, Artificial Sequence
  Linker
ASGGGS

SEQ ID NO: 354 - protein, 26 aa, Artificial Sequence
  Immunostimulatory oligonucleotide
ICICICICICICICICICICICICIC

SEQ ID NO: 355 - protein, 11 aa, Artificial Sequence
  Polycationic polymer
KLKLLLLLKLK

SEQ ID NO: 356 - DNA, 933 bp, Artificial Sequence
  Mutated sequence
tcaccaggaaaagataaccctaaaaataaggagctatcagttgtcaaacaagtaaaagtagctgttccagatggactaccagcagtggcaatagctaaacttgcaaatgaaaatccagagattaaagaaggatatgaaacagtgtatagcattgaaaagacacctgaggcgatttccactagagtgatgaaaaaagatgcagatatagctatagttccttcaaacatggctgcaatagcgtataataaaacttcatcatataatattgttggaactgtaggaatgggttcactttatttggtgtcaacagaaaatataaaagattactctgatttagttggtaaagaagttggatgtactggaaaaggacttactccagacataactataaaaagtcttttgttacaaaaggatataaattattcagatataaaatttaattatgtaagttcagcaagtgaactggtaccattattggctactggtaaagttaaaacaggtattgttccagaacctgcacttagtgctttgatgtctaaaaatccagacataaaaattataaaaagtttaaatgactcatggaaggaagtaagtggttcaaaagacggttatcctcaatctactttaattgtaaagtctgaatttttaagagataataaagattttgttgattcttttgtaggtcaattatcaaatagtatagattgggcaaacaaaaatcctgaagaattaggtgcatattctgaaaaaataaaaatatctactgaatcaaagataataggaaaatctcttgaaagagctaatttgaaatatattccagttaaggacatgattaaagattataaaaattactatgagaaattagctaattttgatgataagacattaggaggcaaagtaccagatgaagcaatatactttgttgagaaataa

SEQ ID NO: 357 - protein, 310 aa, Artificial Sequence
  Mutated sequence
SPGKDNPKNKELSVVKQVKVAVPDGLPAVAIAKLANENPEIKEGYETVYSIEKTPEAISTRVMKKDADIAIVPSNMAAIAYNKTSSYNIVGTVGMGSLYLVSTENIKDYSDLVGKEVGCTGKGLTPDITIKSLLLQKDINYSDIKFNYVSSASELVPLLATGKVKTGIVPEPALSALMSKNPDIKIIKSLNDSWKEVSGSKDGYPQSTLIVKSEFLRDNKDFVDSFVGQLSNSIDWANKNPEELGAYSEKIKISTESKIIGKSLERANLKYIPVKDMIKDYKNYYEKLANFDDKTLGGKVPDEAIYFVEK

SEQ ID NO: 358 - DNA, 1203 bp, Artificial Sequence
  Mutated sequence
tcaaaaaaagaagattctaaaggcaaagagggtaaagaaaaattagttgtatggtctgcaccattaacagaccatgatgcagatgcatggaagccgatatttgaaaaatttgaaaaagaaaataactgtgaaattgaatttcagatagtaccatgggataactacgcagaaaaatatgcaacagcaataagtgcaggtgaaggtccagatataggatacatgtatgcagagatgtttcctcaatttatagaaatgggtgcggtagaagatttaacaccttatttagaaaaatcaggaacttcagataattatctatacttagatgatgcaaaaatgatgggtggtatttatggtttacctatagaagctgctaatccaggcgtattgtactacaataaagatatactagaaaaattaggagaaaaacctccaaaaacatgggatgattttaaaagaatctgtgaaaaagcaacaaaagatactgatggagatggaaaaatcgaccagtggggtcttgcacaaggttggggttctaaagtatttggaagcttaaactggaactggtatccgtatttatggcaagctggtggagatatatataatgatgatttaaaatcagttaaatttaataatgcagaaggcttgaaagctgcaaactttataaatgatatgaaaaagtatattccagaagatgctttatcaaaagatagtaatgaaatgattgaaagtgtatttggaccaggaaaagctgcatttactataatgctatcctctgctgctacaagtacttttgataaatcattcccggatttaaactggggatatgtaacatcattagaagataagacagttggaagttttgcttcagtagatgatttaacattaatgtcagcatgtaaaaataaagaacttggatttaaacttcttgagtatatgctaagcaaagaatcaatggaagctttccacaaagaaatacctagagctccagttgctaaaggtgaaaaataccaaggagacccaagatttgaagaaatggtgacaagagataaacatatgtatagaccattgacagttggacctcatggagtagagatatatgaatatttatggaaacaacttcaaatgatgatagctggagacataactccagaacaagcactaaatgaatctgcaaaatatgcaaatggattactagcacaataa

SEQ ID NO: 359 - protein, 400 aa, Artificial Sequence
  Mutated sequence
SKKEDSKGKEGKEKLVVWSAPLTDHDADAWKPIFEKFEKENNCEIEFQIVPWDNYAEKYATAISAGEGPDIGYMYAEMFPQFIEMGAVEDLTPYLEKSGTSDNYLYLDDAKMMGGIYGLPIEAANPGVLYYNKDILEKLGEKPPKTWDDFKRICEKATKDTDGDGKIDQWGLAQGWGSKVFGSLNWNWYPYLWQAGGDIYNDDLKSVKFNNAEGLKAANFINDMKKYIPEDALSKDSNEMIESVFGPGKAAFTIMLSSAATSTFDKSFPDLNWGYVTSLEDKTVGSFASVDDLTLMSACKNKELGFKLLEYMLSKESMEAFHKEIPRAPVAKGEKYQGDPRFEEMVTRDKHMYRPLTVGPHGVEIYEYLWKQLQMMIAGDITPEQALNESAKYANGLLAQ

SEQ ID NO: 360 - DNA, 510 bp, Artificial Sequence
  Mutated sequence
actaatgctcaaaatggaagtgattcatctaaaaaagaaactaagagcaatacaaatgttgagcaaccaaaagaagaaaacaatactgaaaaagaggttcctaataacaaagctaaacctactccaaaagaagaaactaaagctcaatcagctactatttactcttttgatgtagataagacagatttaattgaaaataaagttgatttaaataaaattgatgagaacactttatttgaagaacttcaaaaacttaaagttgttccagaatctgcaaaattaaattcatttactacaaaagacattgatggtgtaaaaactggtatattagatgttagctctgactttacaaagtcaaacttaggtagtgatgcagaaactttaatgcttgattcagttgctcgtacttacataaaaaatatgaatgttgaacaaataaaaattactgttgatggttctaattacgaaagtggtcatatagttcttgaagaaggagattacttaaagtaa

SEQ ID NO: 361 - protein, 169 aa, Artificial Sequence
  Mutated sequence
TNAQNGSDSSKKETKSNTNVEQPKEENNTEKEVPNNKAKPTPKEETKAQSATIYSFDVDKTDLIENKVDLNKIDENTLFEELQKLKVVPESAKLNSFTTKDIDGVKTGILDVSSDFTKSNLGSDAETLMLDSVARTYIKNMNVEQIKITVDGSNYESGHIVLEEGDYLK

SEQ ID NO: 362 - DNA, 22 bp, Artificial Sequence
  Primer
tcaagtataagtccagtaagag

SEQ ID NO: 363 - DNA, 19 bp, Artificial Sequence
  Primer
attaccttgtgcttgtgag

SEQ ID NO: 364 - DNA, 23 bp, Artificial Sequence
  Primer
agagttaatacaaatgtaagtgc

SEQ ID NO: 365 - DNA, 24 bp, Artificial Sequence
  Primer
tcctaataattgtaaaactccttg

SEQ ID NO: 366 - DNA, 20 bp, Artificial Sequence
  Primer
tgttcaatggaaggaccaag

SEQ ID NO: 367 - DNA, 25 bp, Artificial Sequence
  Primer
attcttaaagtcttttatattttcc

SEQ ID NO: 368 - DNA, 22 bp, Artificial Sequence
  Primer
ccagcattgtttagaaatatag

SEQ ID NO: 369 - DNA, 19 bp, Artificial Sequence
  Primer
atttaaaggaccccatccc

SEQ ID NO: 370 - DNA, 25 bp, Artificial Sequence
  Primer
ctagataagattgaaaatattcaag

SEQ ID NO: 371 - DNA, 20 bp, Artificial Sequence
  Primer
cttctttacagcatccaaac

SEQ ID NO: 372 - DNA, 21 bp, Artificial Sequence
  Primer
tgttcaccaggaaaagataac

SEQ ID NO: 373 - DNA, 21 bp, Artificial Sequence
  Primer
tttctcaacaaagtatattgc

SEQ ID NO: 374 - DNA, 20 bp, Artificial Sequence
  Primer
cttgaaaagggaacagtaac

SEQ ID NO: 375 - DNA, 21 bp, Artificial Sequence
  Primer
aacaaatcttcttgcaccaag

SEQ ID NO: 376 - DNA, 24 bp, Artificial Sequence
  Primer
tgttcatcaggaaataataaaaat

SEQ ID NO: 377 - DNA, 20 bp, Artificial Sequence
  Primer
ctcattaataggctccttag

SEQ ID NO: 378 - DNA, 25 bp, Artificial Sequence
  Primer
tgtagtagtaaaccaaaagaaaaag

SEQ ID NO: 379 - DNA, 21 bp, Artificial Sequence
  Primer
taatacctttgctttccagtc

SEQ ID NO: 380 - DNA, 25 bp, Artificial Sequence
  Primer
tgttcaaaaaaagaagattctaaag

SEQ ID NO: 381 - DNA, 21 bp, Artificial Sequence
  Primer
ttgtgctagtaatccatttgc

SEQ ID NO: 382 - DNA, 22 bp, Artificial Sequence
  Primer
aatcccaaaagagagttgatag

SEQ ID NO: 383 - DNA, 23 bp, Artificial Sequence
  Primer
gctcttaaatagactataatcac

SEQ ID NO: 384 - DNA, 27 bp, Artificial Sequence
  Primer
actgaatctaatgctatggaaaataac

SEQ ID NO: 385 - DNA, 26 bp, Artificial Sequence
  Primer
ttttaatgaatcttctatgcctttac

SEQ ID NO: 386 - DNA, 26 bp, Artificial Sequence
  Primer
tgtagtaatactaaaacaaaacaaag

SEQ ID NO: 387 - DNA, 24 bp, Artificial Sequence
  Primer
atttgattcattcgattttatatc

SEQ ID NO: 388 - DNA, 25 bp, Artificial Sequence
  Primer
cttgaaacaatttatactattcaag

SEQ ID NO: 389 - DNA, 24 bp, Artificial Sequence
  Primer
tttatattcaaaaaaatcttctcc

SEQ ID NO: 390 - DNA, 25 bp, Artificial Sequence
  Primer
tcaaatactttcgcagatactatag

SEQ ID NO: 391 - DNA, 27 bp, Artificial Sequence
  Primer
tgtcatatctaactttaacttcttttc

SEQ ID NO: 392 - DNA, 23 bp, Artificial Sequence
  Primer
gacaatactacaaagcaagaaag

SEQ ID NO: 393 - DNA, 29 bp, Artificial Sequence
  Primer
atcatctatttcaaattctaatattttac

SEQ ID NO: 394 - DNA, 25 bp, Artificial Sequence
  Primer
tttacaccaatagtatcttatgctg

SEQ ID NO: 395 - DNA, 23 bp, Artificial Sequence
  Primer
ttttactattgtatcatctcttg

SEQ ID NO: 396 - DNA, 23 bp, Artificial Sequence
  Primer
cattcaggaagaactgattcatc

SEQ ID NO: 397 - DNA, 24 bp, Artificial Sequence
  Primer
ataagtagcatttctacttttctc

SEQ ID NO: 398 - DNA, 25 bp, Artificial Sequence
  Primer
tatagtacatctagcaacaaaagtg

SEQ ID NO: 399 - DNA, 25 bp, Artificial Sequence
  Primer
tttgaagtatgttgttgttttactc

SEQ ID NO: 400 - DNA, 23 bp, Artificial Sequence
  Primer
tacaaagtaaatgctgatgagac

SEQ ID NO: 401 - DNA, 28 bp, Artificial Sequence
  Primer
tttagttgtcttatttatactcatattc

SEQ ID NO: 402 - DNA, 23 bp, Artificial Sequence
  Primer
caaactgtggcaacaaatttaac

SEQ ID NO: 403 - DNA, 23 bp, Artificial Sequence
  Primer
gttagaacttggactatttccac

SEQ ID NO: 404 - DNA, 25 bp, Artificial Sequence
  Primer
aaggtaggtcaaataaaatttagtg

SEQ ID NO: 405 - DNA, 29 bp, Artificial Sequence
  Primer
ttttaatatattaaataaacttgatagcc

SEQ ID NO: 406 - DNA, 33 bp, Artificial Sequence; identical to SEQ ID NO: 217
  Primer

SEQ ID NO: 407 - DNA, 21 bp, Artificial Sequence
  Primer
atcctctgtttctaagtcttg

SEQ ID NO: 408 - DNA, 27 bp, Artificial Sequence
  Primer
ggatatagaagtattaataagtcattt

SEQ ID NO: 409 - DNA, 23 bp, Artificial Sequence
  Primer
tcttaaaacatcaaacattcctc

SEQ ID NO: 410 - DNA, 19 bp, Artificial Sequence
  Primer
ttaccgagtacacccgttc

SEQ ID NO: 411 - DNA, 24 bp, Artificial Sequence
  Primer
attgtagatagaatgggcttcatc

SEQ ID NO: 412 - DNA, 21 bp, Artificial Sequence
  Primer
gatgaagcccattctatctac

SEQ ID NO: 413 - DNA, 17 bp, Artificial Sequence
  Primer
gtcgctaggtctgctag

SEQ ID NO: 414 - DNA, 24 bp, Artificial Sequence
  Primer
tcagaattaggagagaatagtcag

SEQ ID NO: 415 - DNA, 24 bp, Artificial Sequence
  Primer
tttatcatcatttattgaaatctg

SEQ ID NO: 416 - DNA, 26 bp, Artificial Sequence
  Primer
tcaccaataagtaatgttgttataac

SEQ ID NO: 417 - DNA, 20 bp, Artificial Sequence
  Primer
tactggtggatttaccaaag

SEQ ID NO: 418 - DNA, 41 bp, Artificial Sequence
  Primer
ctgtacttccagggcatgtcaagtataagtccagtaagagt

SEQ ID NO: 419 - DNA, 36 bp, Artificial Sequence
  Primer
aattaagtcgcgttaatccatcaatgcattataatc

SEQ ID NO: 420 - DNA, 38 bp, Artificial Sequence
  Primer
ctgtacttccagggcgataaggtttatggattagttac

SEQ ID NO: 421 - DNA, 39 bp, Artificial Sequence
  Primer
aattaagtcgcgttaattaccttgtgcttgtgagaaata

SEQ ID NO: 422 - DNA, 24 bp, Artificial Sequence
  Primer
tcagaattaggagagaatagtcag

SEQ ID NO: 423 - DNA, 20 bp, Artificial Sequence
  Primer
tactggtggatttaccaaag

SEQ ID NO: 424 - DNA, 23 bp, Artificial Sequence
  Primer
tgtactaatgctcaaaatggaag

SEQ ID NO: 425 - DNA, 24 bp, Artificial Sequence
  Primer
ctttaagtaatctccttcttcaag

SEQ ID NO: 426 - DNA, 801 bp, Artificial Sequence
  Clostridium difficile
tcagatacaattaaaggtaacaatatatatgagacggctggattaatagcagataaaaagagttatgatacagcaattatggtaaatatggataattctatagcagatggtctttcagcaagtggtcttgcaggtgctgttgatgctccaattttgcttgcacaaaaaaataagataccaaatgaaacaaaacaaagattaaaaaatgttaaaaagatatacataataggtaaagaattatcaataagtaagtcagtagaaactgaactaaaaaacacaggggcacaggtaactagattaggtggagatgacagaataaagactagttatagtgttgctaaagaggtaaatggtatcaaaaaagttgatgaagtgatattaactaatgcatataaaggagaagcagatacaataagtgctgcacctgtatcagtaagagatatagctcctatagtacttacagatggaaagagtgtgcctttttcaacaagcaatgtaaaaacatatgcagtaggtgggagtatatcaatgagcactagtttagttaataaaactaatgctaaaagacttggtggttcagatagatatgatacaaataagaaagttataaaagagttttatccagatgcatcagaattttatttgagtgatggatatgatttagtaaatgcacttacaggttctacaattgctaaggaaaatccaattgtattggtgtcagaaagtagtgataagtctatattagcaggagcagataagattactagattaggttcaataagtgacagtgtgtataataag

SEQ ID NO: 427 - protein, 267 aa, Artificial Sequence
  Clostridium difficile
SDTIKGNNIYETAGLIADKKSYDTAIMVNMDNSIADGLSASGLAGAVDAPILLAQKNKIPNETKQRLKNVKKIYIIGKELSISKSVETELKNTGAQVTRLGGDDRIKTSYSVAKEVNGIKKVDEVILTNAYKGEADTISAAPVSVRDIAPIVLTDGKSVPFSTSNVKTYAVGGSISMSTSLVNKTNAKRLGGSDRYDTNKKVIKEFYPDASEFYLSDGYDLVNALTGSTIAKENPIVLVSESSDKSILAGADKITRLGSISDSVYNK

SEQ ID NO: 428 - DNA, 402 bp, Artificial Sequence
  Clostridium difficile
ttaataccaatattatatgatactgctgttcaggaaggtgttaatcctgttttggcagtagctcaatctgcaaaagaaactggtttttgtaattttggtggagtattagatgcatcatttaagaatccttgtggacttaaaacttctgtaggtggttctgatactgataagaatgcccattcaagatttgatacttgggaagaaggaatattagctcaaattcaacatttatgcttatatgcaggacaagatggttacccactttcaaatccagtagaccctagacatgaaaaatctttatttggtaaggctaaaacagttgaaagtttatctaataattgggctggaggtcaatatggacaagatttagtaagaatgatgggagaaattgaggcaacaaaa

SEQ ID NO: 429 - protein, 134 aa, Artificial Sequence
  Clostridium difficile
LIPILYDTAVQEGVNPVLAVAQSAKETGFCNFGGVLDASFKNPCGLKTSVGGSDTDKNAHSRFDTWEEGILAQIQHLCLYAGQDGYPLSNPVDPRHEKSLFGKAKTVESLSNNWAGGQYGQDLVRMMGEIEATK

SEQ ID NO: 430 - DNA, 834 bp, Artificial Sequence
  Clostridium difficile
atgtcaagtataagtccagtaagagttacaggcctttcaggaaattttgatatggaaggtataatagaagctagtatgataagagataaggaaaaagttaataaagcgaaacaagatcaacaaatagttaaatggaaacaagaaatatacagggatattataaaagagtcaaagaatctttatgacaagtatttaaatggagactctcctaatagtataacaaataaaaaagcatattctgctacaagaataactagttctgatgaaagtattatagtagcaaaaggctcagctggtgcagaaaaaataaattatcaatttgcagtttctcaaatggctgaaccagcaaaagtaactattaagttaaattcaagtgaccctattgttcaacagtttcctccaaatgctagtggagcaagttctttaaatataggtggtgtaaatataccaatatctgaacaagatactacaagtactattgtaagtaagataaactccctttgtgcagataatgatataagagcttcttatagtgagatgacaggtgaattgattatctcaagaaaacagactggttcatcatcagatattgatttaaaagtaattggaaatgatagtttagctggacaaattgccagtgataatggtattacatttacaactgatgctagtggaactaaatctgcagtagtatatggaaaaaatttagaagctgatgtaactgatgaccaaggaagagtaacacacataagtaaagaacagaattcatttaaaatagataacattgattataatgtaaattcaaaaggaagtgctaaactggtttctgttact

SEQ ID NO: 431 - protein, 248 aa, Artificial Sequence
  Clostridium difficile
EKVNKAKQDQQIVKWKQEIYRDIIKESKNLYDKYLNGDSPNSITNKKAYSATRITSSDESIIVAKGSAGAEKINYQFAVSQMAEPAKVTIKLNSSDPIVQQFPPNASGASSLNIGGVNIPISEQDTTSTIVSKINSLCADNDIRASYSEMTGELIISRKQTGSSSDIDLKVIGNDSLAGQIASDNGITFTTDASGTKSAVVYGKNLEADVTDDQGRVTHISKEQNSFKIDNIDYNVNSKGSAKLVSVT

SEQ ID NO: 432 - DNA, 2721 bp, Artificial Sequence
  Clostridium difficile
tcagaattaggagagaatagtcagattcaaagtggttcaactaattcatcaactggagaggagaaggaaagcgacaataaaaagccagaacagactccagagaaagataaggcaacagataataaaaaaccagaacagaccccagaggaagaaaaaccaacagataataaaaaaccagaacagaccccagaagaagataagtcaacagataataaaaagccagagcaaactccagaaggagaaaagccaatagataataaaaagccagagcagataccagaagaagataagtcaacagataataaaaagtcagaacaagctttagaagatgaaaaaccactagacaataaaaatacagaaaaaactccagaggaagataatctattagaagatgaaaatttattgaaagttttagaagaagaacttaatgaagaaaatgaagactatggatttgttgtaaaaattaataacaatacaatagaaacggaatcaatgaaaaaaatatcatttaatttaacttatactccaacatcaaaaggaatacaagcaggagattcaataacttttaaggtgccagatgtattcaataaagttaatttagattatacaagtgaatgctttgataaaacagaaagtaatggagagtatacacttacatttagagaattacctaatggccaaagtgtaatgcaaggtaaaataggtttggaagcatatgttaaaaaggttgatgaagatactaatgcaaaaatacatattgaaactactggaaaaatagaaagtggaagtggagatatagatgtagaaataaaacctggagataaaacggatgttccagatgctaaaggaacacttaaaaagcttgttgaaggaaaaaaatcaactactgtatttatgccagttaaaaataaagatataaattacagtatacaagtaaatgaaaagcaggaagagttaaaagatattattttgtatgatgagcttcctgaaggattgacattgataaatggttctgtaagtgtagtaacaagtgatggaaaagaagttagtgattttaatattgaacagagtaaaaattctatttcagttaattttggaaatatagataaatcgtatactgttaagtataaggctagaatcagtgacaaaaatgcaaaacatggtaataaatataagaatgtagctaggattgaatctgatggtaagaagatacaagaagatgatgctactgtaagtatatttgatagaggagatgattatcttcttactaaaggacattcaggagcaacaaatattactcaagttggtcaagtaataaactatcagatttcaataaatgatgataaatcaccaataagtaatgttgttataacagataatataccagaaggcatgagattaactacttcaggagaagctgggcatgattttagagttgtagaaattccaatgaatgggagctggactccttggagtaaagaaaaaattgccaataatatttcatataaagtagaagaaaaaagaaatgaaagtgggcaagtagataaagttataactggatttacaattaatctcagtaaagaagaagtggaatcaaagttttttatagcttatacattaaaggtaattagtattgaagatagctatataaatagagctgttcttgatgcaaataatagtgaaattgataaaaatgatgagataaactttaagaaaaattctggattaataagcgcaaaaaaagaagttgataaaaaagttttaaacagtagtgataaccagattgttaaatacaaaatcaatatgtcaacttatggagtttatgatgcaggacaagtaaatcttttagatgaagtaaactcagttctagaaatatctaatataaaatattctgataatcttgaacttaaaaaagaagctggagatggaaaaaatacaataagattagtaaataaatacgaatttaaacagataaaagaaggggaacctgtgcaaagttgggttacatttgatgcaaacttcacaaatgtaaaagttggggagactatacgaaatgtggctcagattaatggttcaagtcctccaggagtagagactactaagcaaggttatgcttttgaagctaaaaaagtggatgctttagataaaaatgtactttcaggtgctaagttcaatttagaagatgcatttggaaatatagtagttaaggatttagtcagtgatgaagatggtataattcaatctagtgtaaaaaacccaggaacatattatttagtggagataatggctccacgtggatatgaaaaactgaaggataaaattaaggttgaaattggtaataaagatattggtagaatagtggatattggaaatatagaaaacataagacaagaaaatccaccagtaaatccaccagcaccaccaaatacagatgaaccaatagtaaatccaccagtaccaccaagcacagataaaccaaggaaaccatcaagttcatctgatacagaggatactatagttataaatccaccagtaccaccatcagaagatataataaatccgccaataccagaggtattgaatcctccagtaccaccatcagaagagatgatagaaactcctgttaaacagattattccaataccagaagtagtaaagccatcagtgtcagaagaaaaaaataataaagttaaagatgatactttggtaaatccaccagta

SEQ ID NO: 433 - protein, 907 aa, Artificial Sequence
  Clostridium difficile
SELGENSQIQSGSTNSSTGEEKESDNKKPEQTPEKDKATDNKKPEQTPEEEKPTDNKKPEQTPEEDKSTDNKKPEQTPEGEKPIDNKKPEQIPEEDKSTDNKKSEQALEDEKPLDNKNTEKTPEEDNLLEDENLLKVLEEELNEENEDYGFVVKINNNTIETESMKKISFNLTYTPTSKGIQAGDSITFKVPDVFNKVNLDYTSECFDKTESNGEYTLTFRELPNGQSVMQGKIGLEAYVKKVDEDTNAKIHIETTGKIESGSGDIDVEIKPGDKTDVPDAKGTLKKLVEGKKSTTVFMPVKNKDINYSIQVNEKQEELKDIILYDELPEGLTLINGSVSVVTSDGKEVSDFNIEQSKNSISVNFGNIDKSYTVKYKARISDKNAKHGNKYKNVARIESDGKKIQEDDATVSIFDRGDDYLLTKGHSGATNITQVGQVINYQISINDDKSPISNVVITDNIPEGMRLTTSGEAGHDFRVVEIPMNGSWTPWSKEKIANNISYKVEEKRNESGQVDKVITGFTINLSKEEVESKFFIAYTLKVISIEDSYINRAVLDANNSEIDKNDEINFKKNSGLISAKKEVDKKVLNSSDNQIVKYKINMSTYGVYDAGQVNLLDEVNSVLEISNIKYSDNLELKKEAGDGKNTIRLVNKYEFKQIKEGEPVQSWVTFDANFTNVKVGETIRNVAQINGSSPPGVETTKQGYAFEAKKVDALDKNVLSGAKFNLEDAFGNIVVKDLVSDEDGIIQSSVKNPGTYYLVEIMAPRGYEKLKDKIKVEIGNKDIGRIVDIGNIENIRQENPPVNPPAPPNTDEPIVNPPVPPSTDKPRKPSSSSDTEDTIVINPPVPPSEDIINPPIPEVLNPPVPPSEEMIETPVKQIIPIPEVVKPSVSEEKNNKVKDDTLVNPPV

SEQ ID NO: 434 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 435 - protein, 220 aa, Artificial Sequence; identical to SEQ ID NO: 300
  Mutated sequence

SEQ ID NO: 436 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgcaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 437 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHATAHAIDHIVLNDISKSAQFKQIFAKEGRSLGNVNYLGVYPEEFFAESFAYYYLNQDTNSKLKSACPQTYSFLQNLAK

SEQ ID NO: 438 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagacgcaatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 439 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIDAIVLNDISKSAQFKQIFAKEGRSLGNVNYLGVYPEEFFAESFAYYYLNQDTNSKLKSACPQTYSFLQNLAK

SEQ ID NO: 440 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagaccatatagtattaaatgatatatctaaatcagcacaattcaaacaaatatttgctaaagaaggtcgttctttaggtaatgtaaacttcttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 441 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIDHIVLNDISKSAQFKQIFAKEGRSLGNVNFLGVYPEEFFAESFAYYYLNQDTNSKLKSACPQTYSFLQNLAK

SEQ ID NO: 442 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttctccacaaacttatagctttttgcaaaatttagctaaataa

SEQ ID NO: 443 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIDHIVLNDISKSAQFKQIFAKEGRSLGNVNYLGVYPEEFFAESFAYYYLNQDTNSKLKSASPQTYSFLQNLAK

SEQ ID NO: 444 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagctgaaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 445 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELAETAHAIDHIVLNDISKSAQFKQIFAKEGRSLGNVNYLGVYPEEFFAESFAYYYLNQDTNSKLKSACPQTYSFLQNLAK

SEQ ID NO: 446 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgaaacagcagctgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 447 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAAAIDHIVLNDISKSAQFKQIFAKEGRSLGNVNYLGVYPEEFFAESFAYYYLNQDTNSKLKSACPQTYSFLQNLAK

SEQ ID NO: 448 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagctgaaacagcagctgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 449 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELAETAAAIDHIVLNDISKSAQFKQIFAKEGRSLGNVNYLGVYPEEFFAESFAYYYLNQDTNSKLKSACPQTYSFLQNLAK

SEQ ID NO: 450 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagcagcaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 451 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELAATAHAIDHIVLNDISKSAQFKQIFAKEGRSLGNVNYLGVYPEEFFAESFAYYYLNQDTNSKLKSACPQTYSFLQNLAK

SEQ ID NO: 452 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagcacgaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 453 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELARTAHAIDHIVLNDISKSAQFKQIFAKEGRSLGNVNYLGVYPEEFFAESFAYYYLNQDTNSKLKSACPQTYSFLQNLAK

SEQ ID NO: 454 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagcagaaacagcacatgcaatagaccatatagtattaaatgatatatctaaatcagcacaattcaaacaaatatttgctaaagaaggtcgttctttaggtaatgtaaacttcttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 455 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELAETAHAIDHIVLNDISKSAQFKQIFAKEGRSLGNVNFLGVYPEEFFAESFAYYYLNQDTNSKLKSACPQTYSFLQNLAK

SEQ ID NO: 456 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgcaacagcacatgcaatagaccatatagtattaaatgatatatctaaatcagcacaattcaaacaaatatttgctaaagaaggtcgttctttaggtaatgtaaacttcttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 457 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHATAHAIDHIVLNDISKSAQFKQIFAKEGRSLGNVNFLGVYPEEFFAESFAYYYLNQDTNSKLKSACPQTYSFLQNLAK

SEQ ID NO: 458 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattagcagaaacagcacatgcaatagacgcaatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 459 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELAETAHAIDAIVLNDISKSAQFKQIFAKEGRSLGNVNYLGVYPEEFFAESFAYYYLNQDTNSKLKSACPQTYSFLQNLAK

SEQ ID NO: 460 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattacatgcaacagcacatgcaatagcacatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 461 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHATAHAIAHIVLNDISKSAQFKQIFAKEGRSLGNVNYLGVYPEEFFAESFAYYYLNQDTNSKLKSACPQTYSFLQNLAK

SEQ ID NO: 462 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgaaataaatttagaattacatgcaacagcacatgcaatagcacatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 463 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHETAHAIAHIVLNDISKSAQFKQIFAKEGRSLGNVNYLGVYPEEFFAESFAYYYLNQDTNSKLKSACPQTYSFLQNLAK

SEQ ID NO: 464 - DNA, 636 bp, Artificial Sequence
  Mutated sequence
atgggcagcagccatcatcatcatcatcacgaaaacctgtacttccagggcgatagtactactatacaacaaaataaagacacacttagtcaaatagtagtttttccaactggaaattacgataaaaacgaagctaatgctatggtaaatagattagctaatatagatggaaagtatttaaatgcattaaagcaaaataacttaaaaataaaattattaagtggaaagttaacagatgaaaaagaatatgcttatttaaaaggtgtagttcctaagggatgggaaggtactggaaaaacttgggatgatgttccaggtttaggtggaagtacagtagctcttagaataggatttagtaacaaaggtaaagggcatgatgcaataaatttagaattactacgaacagcacatgcaatagaccatatagtattaaatgatatatctaaatcagcacaattcaaacaaatatttgctaaagaaggtcgttctttaggtaatgtaaactacttaggtgtatatccagaagaattttttgcagaatcatttgcatattactatttaaatcaagatacaaatagtaagttaaaatcagcttgtccacaaacttatagctttttgcaaaatttagctaaataa

SEQ ID NO: 465 - protein, 220 aa, Artificial Sequence
  Mutated sequence
MRPSKKLLIAIISIFLISSVPVSAHADSTTIQQNKDTLSQIVVFPTGNYDKNEANAMVNRLANIDGKYLNALKQNNLKIKLLSGKLTDEKEYAYLKGVVPKGWEGTGKTWDDVPGLGGSTVALRIGFSNKGKGHDAINLELHRTAHAIDHIVLNDISKSAQFKQIFAKEGRSLGNVNYLGVYPEEFFAESFAYYYLNQDTNSKLKSACPQTYSFLQNLAK

SEQ ID NO: 466 - DNA, 36 bp, Artificial Sequence
  Primer
ttagaattagctgaaacagcacatgcaatagaccat

SEQ ID NO: 467 - DNA, 36 bp, Artificial Sequence
  Primer
tgtttcagctaattctaaatttattgcatcatgccc

SEQ ID NO: 468 - DNA, 39 bp, Artificial Sequence
  Primer
gaaacagcagctgcaatagaccatatagtattaaatgat

SEQ ID NO: 469 - DNA, 39 bp, Artificial Sequence
  Primer
tattgcagctgctgtttcatgtaattctaaatttattgc

SEQ ID NO: 470 - DNA, 39 bp, Artificial Sequence
  Primer
gaattagctgaaacagcagctgcaatagaccatatagta

SEQ ID NO: 471 - DNA, 42 bp, Artificial Sequence
  Primer
tattgcagctgctgtttcagctaattctaaatttattgcatc

SEQ ID NO: 472 - DNA, 31 bp, Artificial Sequence
  Primer
gaattacatgcaacagcacatgcaatagacc

SEQ ID NO: 473 - DNA, 31 bp, Artificial Sequence
  Primer
gtgctgttgcatgtaattctaaatttattgc

SEQ ID NO: 474 - protein, 221 aa, Bacillus anthracis
DTKIQEAQLNINQEWNKALGLPKYTKLITFNVHNRYASNIVESAYLILNEWKNNIQSDLIKKVTNYLVDGNGRFVFTDITLPNIAEQYTHQDEIYEQVHSKGLYVPESRSILLHGPSKGVELRNDSEGFIHEFGHAVDDYAGYLLDKNQSDLVTNSKKFIDIFKEEGSNLTSYGRTNEAEFFAEAFRLMHSTDHAERLKVQKNAPKTFQFINDQIKFIINS

The invention claimed is:

1. An immunogenic composition comprising (a) and/or (b) and always (c):
   a) a *C. difficile* Dif44 polypeptide (i) comprising an amino acid sequence having 90% or more identity to SEQ ID NO:139; or (ii) comprising a fragment of at least 20 consecutive amino acids of SEQ ID NO:139;
   b) a nucleic acid molecule encoding the polypeptide of (a);
   c) an adjuvant.

2. The immunogenic composition of claim 1, which comprises the *C. difficile* polypeptide of (a), which is Dif44.

3. The immunogenic composition of claim 1, wherein the *C. difficile* polypeptide of a(i) or a(ii) of claim 1 further comprises at least one glucosyl transferase domain of *C. difficile* Toxin B (ToxB-GT) antigen and/or at least one *C. difficile* Toxin A (TcdA) antigen.

4. The immunogenic composition of claim 3, wherein the ToxB-GT antigen and/or the TcdA antigen are detoxified.

5. The immunogenic composition of claim 3, wherein the ToxB-GT antigen comprises an amino acid sequence:
   a) having 90% or more identity to SEQ ID NO:18 or SEQ ID NO: 60; and/or
   b) that is a fragment of at least 20 consecutive amino acids of SEQ ID NO: 18 or SEQ ID NO: 60, or of a polypeptide having 90% or more identity to SEQ ID NO:18 or SEQ ID NO: 60 and that comprises an epitope of SEQ ID NO:18 or SEQ ID NO: 60.

6. The immunogenic composition of claim 3, wherein the TcdA antigen-comprises an amino acid sequence:
   a) having 90% or more identity to SEQ ID NO: 11, 1, 3, 4, 5, 6, 7, 8, 9, 10, 12, 13, 14, 15 or 16; and/or
   b) that is a fragment of at least 20 consecutive amino acids of any of SEQ ID NOs: 11, 1, 3, 4, 5, 6, 7, 8, 9, 10, 12, 13, 14, 15 or 16, or of a polypeptide having 90% or more identity to any of SEQ ID NOs: 11, 1, 3, 4, 5, 6, 7, 8, 9, 10, 12, 13, 14, 15 or 16 and that comprises an epitope of any of SEQ ID NOs: 11, 1, 3, 4, 5, 6, 7, 8, 9, 10, 12, 13, 14, 15 or 16.

7. The immunogenic composition of claim 6, wherein the *C. difficile* polypeptide of a(i) or a(ii) comprises 1, 2, 3, 4, 5, 6, 7, 8, 9, 10, 11, 12, 13, 14, 15 or more additional TcdA antigens, optionally selected from (1) a Toxin A enzymatic domain (ToxA-ED) antigen (SEQ ID NO: 3), (2) a Toxin A glucosyl transferase domain (ToxA-GT) antigen (SEQ ID NO: 4), (3) a Toxin A cystenine protease domain (ToxA-CP) antigen (SEQ ID NO:5), (4) a Toxin A translocation domain (ToxA-T) antigen (SEQ ID NO: 6), (5) a ToxA-T4 antigen (SEQ ID NO: 7), (6) a Toxin A binding domain (ToxA-B) antigen (SEQ ID NO: 8), (7) a ToxA-PTA2 antigen (SEQ ID NO: 9), (8) a ToxA-P5-7 antigen (SEQ ID NO: 10), (9) a ToxA-P5-6 antigen (SEQ ID NO: 11), (10) a ToxA-P9-10 antigen (SEQ ID NO: 12), (11) a ToxA-B2 antigen (SEQ ID NO: 13), (12) a ToxA-B3 antigen (SEQ ID NO: 14), (13) a ToxA-B5 antigen (SEQ ID NO: 15), (14) a ToxA-B6 antigen (SEQ ID NO: 16) or a full-length TcdA antigen (SEQ ID NO: 1).

8. An immunogenic composition of claim 3, wherein the TcdA antigen is ToxA-P5-6.

9. The immunogenic composition of claim 1, wherein when more than one antigen is present, at least two antigens in the composition are in the form of a hybrid polypeptide.

10. The immunogenic composition of claim 1, wherein no antigens are in the form of a hybrid polypeptide.

11. The immunogenic composition of claim 1, wherein said composition induces neutralisation titers against *C. difficile* toxin A and toxin B when administered to a subject.

12. The immunogenic composition of claim 1, comprising at least one further *C. difficile* antigen, optionally wherein said further *C. difficile* antigen is a saccharide antigen.

13. The immunogenic composition of claim 1, comprising a fragment of at least 50 consecutive amino acids of SEQ ID NO: 139.

14. The immunogenic composition of claim 1, further comprising at least one of i) a *C. difficile* peptide comprising the glucosyl transferase domain of *C. difficile* Toxin B (ToxB-GT) antigen and/or ii) a *C. difficile* Toxin A (TcdA) antigen.

15. The immunogenic composition of claim 14, wherein the ToxB-GT antigen and/or the TcdA antigen are detoxified.

16. The immunogenic composition of claim 14, wherein the ToxB-GT antigen comprises an amino acid sequence:
   a) having 90% or more identity to SEQ ID NO: 18 or SEQ ID NO: 60; and/or
   b) that is a fragment of at least 20 consecutive amino acids of SEQ ID NO: 18 or SEQ ID NO: 60, or of a polypeptide having 90% or more identity to SEQ ID NO:18 or SEQ ID NO: 60 and that comprises an epitope of SEQ ID NO:18 or SEQ ID NO: 60.

17. The immunogenic composition of claim 14, wherein the TcdA antigen comprises an amino acid sequence:
   a) having 90% or more identity to SEQ ID NO: 11, 1, 3, 4, 5, 6, 7, 8, 9, 10, 12, 13, 14, 15 or 16; and/or
   b) that is a fragment of at least 20 consecutive amino acids of any of SEQ ID NOs: 11, 1, 3, 4, 5, 6, 7, 8, 9, 10, 12, 13, 14, 15 or 16, or of a polypeptide having 90% or more identity to any of SEQ ID NOs: 11, 1, 3, 4, 5, 6, 7, 8, 9, 10, 12, 13, 14, 15 or 16 and that comprises an epitope of any of SEQ ID NOs: 11, 1, 3, 4, 5, 6, 7, 8, 9, 10, 12, 13, 14, 15 or 16.

18. The immunogenic composition of claim 17, further comprising 1, 2, 3, 4, 5, 6, 7, 8, 9, 10, 11, 12, 13, 14, 15 or more additional TcdA antigens separately, optionally selected from (1) a Toxin A enzymatic domain (ToxA-ED) antigen (SEQ ID NO: 3), (2) a Toxin A glucosyl transferase domain (ToxA-GT) antigen (SEQ ID NO: 4), (3) a Toxin A cystenine protease domain (ToxA-CP) antigen (SEQ ID NO:5), (4) a Toxin A translocation domain (ToxA-T) antigen (SEQ ID NO: 6), (5) a ToxA-T4 antigen (SEQ ID NO: 7), (6) a Toxin A binding domain (ToxA-B) antigen (SEQ ID NO: 8), (7) a ToxA-PTA2 antigen (SEQ ID NO: 9), (8) a ToxA-P5-7 antigen (SEQ ID NO: 10), (9) a ToxA-P5-6 antigen (SEQ ID NO: 11), (10) a ToxA-P9-10 antigen (SEQ ID NO: 12), (11) a ToxA-B2 antigen (SEQ ID NO: 13), (12) a ToxA-B3 antigen (SEQ ID NO: 14), (13) a ToxA-B5 antigen (SEQ ID NO: 15), (14) a ToxA-B6 antigen (SEQ ID NO: 16) or a full-length TcdA antigen (SEQ ID NO:1).

19. An immunogenic composition of claim 14, wherein the TcdA antigen is ToxA-P5-6.

* * * * *